United States Patent 7,745,391 (HUMAN THROMBOSPONDIN POLYPEPTIDE) - sequence listing, part 267

SEQ ID NO: 765325 - protein, 491 aa, Homo sapiens
MALLTAAARLLGTKNASCLVLAARHASASSTNLKDILADLIPKEQARIKTFRQQHGKTVVGQITVDMMYGGMRGMRGIASYDKHRGFLNPVVAVCQSRLSGGRNRYRHVMPEEQADPKAYRMRRTQLRACSLRGHIFIEQCMGKRENIMRDLEEQGIVGVISKGEQIGSAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765326 - protein, 182 aa, Homo sapiens
MVTSAELVRGGSAQVLDFVKNQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 765327 - protein, 466 aa, Homo sapiens [sequence omitted]

SEQ ID NO: 765328 - protein, 466 aa, Homo sapiens [sequence omitted]

SEQ ID NO: 765329 - protein, 372 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSHNFTNMLGYTDHQFTELTRLYLTIHSDHEGGNVSAHTSHLVGSALSDPYLSFAAAMNGLAGPLHGLANQEVVVLVKTVQKAGWARMCPIEKVRRLILGENSIRRGWPRVRAWRLKGKGSGNNVKEVGWKTGYDPF

SEQ ID NO: 765330 - protein, 250 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWELIYEDSMDLIAKLPCVAAKIYRNLYREGSGIGAIDSNLDWSQYRCLLCRDFGRS

SEQ ID NO: 765331 - protein, 206 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGHIPTEEQVSWLSKEWAKRAALPSHVVTMLDNFPTNLHPMSQLSAAVTALNSESNFARAYAQGISRTKYWEVGNLGGVIGV

SEQ ID NO: 765332 - protein, 107 aa, Homo sapiens
ARTSWVVSTLSTRRRGLWCSGGGSCSCRSSLPFLPPHQIPEIARHGFTYCGRPALGNQECILSCSCSPACQCFLHGKVWKRRLRIRIIAASLTLGQRIWQPPGLLLS

SEQ ID NO: 765333 - protein, 148 aa, Homo sapiens
ARTSWVVSTLSTRRRGLWCSGGGSCSCRSSLPFLPPHQIPEIARHGFTYCGRPALGNQGEQRGEGARRPRVGLRRPQALRRRGLPPTPVRTLRALKGPALGWPPALREATGPCAALPFWLLGVKCTPPALGPQSRTREEADPAVTPHV

SEQ ID NO: 765334 - protein, 72 aa, Homo sapiens
RDVRFESIRLPGCPRGVNPVVSYAVALSCQCALCRRSTTDCGGPKDHPLTCDDPRFQDSSSSKAPPPSLPSP

SEQ ID NO: 765335 - protein, 4368 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRDDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDLEVERWRERVAQVLERWQAVLAQTDLRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAETEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKANVEEARRLRERAEQESARQLQLAQEAAQKRLQAEEKAHAFAVQQKEQELQQTLQQEQSVLDQLRGEAEAARRAAEEAEEARVQAEREAAQARRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAEGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLV

SEQ ID NO: 765336 - protein, 108 aa, Homo sapiens
MGRRGRGAPHISDDGRLGRDAPHFLDGMAAGKRRSSLPRLGSWAEGLLTSQTMGGQAETLLTSQKGWRPGRGCNLGTLGGQGRRLGGGGCSEPRSRHCTPAWATLSIE

SEQ ID NO: 765337 - protein, 67 aa, Homo sapiens
AAGPGHRARPAGDPAPRRVRVVSCRPKRQPKPSSDEGYWDCSVCTFRNSAEAFKCMMCDVRKGTSTR

SEQ ID NO: 765338 - protein, 133 aa, Homo sapiens
AAGPGHRARPAGDPAPRRVRVVSCRPKRQPKPSSDEGYWDCSVCTFRNSAEAFKCMMCDVRKGTSTRDSKEGGKLVSYSTASLGVRGTLRNRVGGGSSEEKKQAEYLAPGRRRNIVHRGVGPGQRSGPSLKEA

SEQ ID NO: 765339 - protein, 180 aa, Homo sapiens
MGDKKSPTRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 765340 - protein, 180 aa, Homo sapiens; identical to SEQ ID NO: 765339

SEQ ID NO: 765341 - protein, 204 aa, Homo sapiens
MGDKKSPTRPKRQPKPSSDEGYWDCSVCTFRNSAEAFKCMMCDVRKGTSTRSTLFEVIVSASRTKEPLKFPISGRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 765342 - protein, 196 aa, Homo sapiens
AAGPGHRARPAGDPAPRRVRVVSCRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 765343 - protein, 104 aa, Homo sapiens
QGGNGGTARRGGAGARGSRGHRGHPRTARRLTRRGCWAALAAFEVSGAAAGWPARVTCAQAGVSPTAGGCVGSGGGSRARRCGLPRPLPPSSPARFRPAYYPPY

SEQ ID NO: 765344 - protein, 171 aa, Homo sapiens
MCGRAPPPEITGREPGYHLVEQSCWLKPLPRNLGHSLFWTVWKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 765345 - protein, 180 aa, Homo sapiens; identical to SEQ ID NO: 765339

SEQ ID NO: 765346 - protein, 141 aa, Homo sapiens
MKILQGWYQWRWKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 765347 - protein, 104 aa, Homo sapiens; identical to SEQ ID NO: 765343

SEQ ID NO: 765348 - protein, 55 aa, Homo sapiens
AVRIQGEERKQKRGRRPGHLWVAEPLSHVGSQATLATRSPTQSRAALGSGASGPG

SEQ ID NO: 765349 - protein, 116 aa, Homo sapiens
MVAQGAGRPCSASTRATEERRGLWGRSGGPCWGRLGFWTPGISFSDVTMWRKAPGGQQCSCRWGLGNARPFPSLPAKTHIPASGSWGRFQSLENTQGLKLEVTPPMSGTCQLSPLG

SEQ ID NO: 765350 - protein, 503 aa, Homo sapiens
VDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPAASTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 765351 - protein, 165 aa, Homo sapiens [sequence omitted]

SEQ ID NO: 765352 - protein, 435 aa, Homo sapiens
LVRPRELRDHHWEIRSSSWLSAATAPPKGGGGRGGLNSELRGEAGVCRCITWIMRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 765353 - protein, 435 aa, Homo sapiens; identical to SEQ ID NO: 765352

SEQ ID NO: 765354 - protein, 337 aa, Homo sapiens
RGGIVVVVNPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 765355 - protein, 46 aa, Homo sapiens
MGLFYELSDVATWRVNREKEDGEITLQTSSPGRGPKIAIEEPNTGL

SEQ ID NO: 765356 - protein, 2449 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765357 - protein, 2449 aa, Homo sapiens; identical to SEQ ID NO: 765356

SEQ ID NO: 765358 - protein, 2504 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDEECWAPGAGAGAGAEWRLSGGLPAASCLSFEHMMPLCMVISWVYSVAMTIQHIVAEKEHRLKEVRGPGLSLEARAGREGRRPPGACPKPLAHPQVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765359 - protein, 2474 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDNMMPLCMVISWVYSVAMTIQHIVAEKEHRLKEVRGPGLSLEARAGREGRRPPGACPKPLAHPQVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765360 - protein, 2474 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTECPPAPRSTHPSPAHPVSDIRHGARVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765361 - protein, 2058 aa, Homo sapiens
RPRWIQFSPSERDIFKAFPDEESIVNYTLNQAYQDNVTVFASVIFQTRKDGSLPPHVHYKIRQNSSVEELYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765362 - protein, 1993 aa, Homo sapiens
PQVGGGPSRNSMPLPHPLQANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEVPGHGGRGPHQLRGGAGPAVLQHGHALLTTQSWAREDTLH

SEQ ID NO: 765363 - protein, 2449 aa, Homo sapiens; identical to SEQ ID NO: 765356

SEQ ID NO: 765364 - protein, 2449 aa, Homo sapiens; identical to SEQ ID NO: 765356

SEQ ID NO: 765365 - protein, 2449 aa, Homo sapiens; identical to SEQ ID NO: 765356

SEQ ID NO: 765366 - protein, 2053 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVTC

SEQ ID NO: 765367 - protein, 2125 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVGSGHVGWGLGGVGPGPGGVGPQQWRWSLGGQGPELWGWGLHGVGLWRGPWALEVGRVWVGWAGRVG

SEQ ID NO: 765368 - protein, 2070 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVGSGHVGWGLGG

SEQ ID NO: 765369 - protein, 158 aa, Homo sapiens
MGTEVPQCLPGPGVEVQDQGASGPPAPVLGHALRSLRLPPLIVPKADPARAAYTLALLCLKASGSARPLAPAWHCSPPKATPAGPGTAGLSPARPRNQLFSLTMKADAESGLWAELGQSRIYFALRRGSSGPALLQGGGCPAGSHQLGPAGRWQEWRS

SEQ ID NO: 765370 - protein, 1878 aa, Homo sapiens
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPGRVGDAWV

SEQ ID NO: 765371 - protein, 216 aa, Homo sapiens
EIFKGESGYLDTKYRGLISFEEERPSCPSTRTRSADHPELGQGGHAPLTTQSWARDSTMGTEVPQCLPGPGVEVQDQGASGPPAPVLGHALRSLRLPPLIVPKADPARAAYTLALLCLKASGSARPLAPAWHCSPPKATPAGPGTAGLSPARPRNQLFSLTMKADAESGLWAELGQSRIYFALRRGSSGPALLQGGGCPAGSHQLGPAGRWQEWRS

SEQ ID NO: 765372 - protein, 110 aa, Homo sapiens
MGTEVPQCLPGPGVEVQDQGASGPPAPVLGHALRSLRLPPLIVPKADPARAAYTLALLCLKASGSARPLAPAWHCSPPKATPAGPGTAGLSPARPRNQLFSLTMKADAES

SEQ ID NO: 765373 - protein, 203 aa, Homo sapiens
MGSRDHLFKVLVVGDAAVGKTSLVQRYSQDSFSKHYKSTVGVDFALKVLQWSDYEIVRLQLWDIAGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 765374 - protein, 203 aa, Homo sapiens; identical to SEQ ID NO: 765373

SEQ ID NO: 765375 - protein, 179 aa, Homo sapiens
MGSRDHLFKVLVVGDAAVGKTSLVQRYSQDSFSKHYKSTVGGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 765376 - protein, 203 aa, Homo sapiens; identical to SEQ ID NO: 765373

SEQ ID NO: 765377 - protein, 203 aa, Homo sapiens; identical to SEQ ID NO: 765373

SEQ ID NO: 765378 - protein, 118 aa, Homo sapiens
SRSCFHLWQLLKEWHWWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 765379 - protein, 203 aa, Homo sapiens; identical to SEQ ID NO: 765373

SEQ ID NO: 765380 - protein, 203 aa, Homo sapiens; identical to SEQ ID NO: 765373

SEQ ID NO: 765381 - protein, 203 aa, Homo sapiens; identical to SEQ ID NO: 765373

SEQ ID NO: 765382 - protein, 203 aa, Homo sapiens; identical to SEQ ID NO: 765373

SEQ ID NO: 765383 - protein, 203 aa, Homo sapiens; identical to SEQ ID NO: 765373

SEQ ID NO: 765384 - protein, 131 aa, Homo sapiens
MTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 765385 - protein, 154 aa, Homo sapiens
RRRPSLSPRLKCGGMIWQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 765386 - protein, 121 aa, Homo sapiens
MGSRDHLFKVLVVGDAAVGKTSLVQRYSQDSFSKHYKSTVGGQERFTSMTRLYYRDASACVIMFDVTNATTFSNSQRWKQDLDSKLTLPNGEPVPCLLLANKVCGQSQKMVPSLYLWLERK

SEQ ID NO: 765387 - protein, 131 aa, Homo sapiens; identical to SEQ ID NO: 765384

SEQ ID NO: 765388 - protein, 458 aa, Homo sapiens
MTRGAWMCRQYDDGLKIWLAAPRENEKPFIDSERAQKWRLSLASLLFFTVLLSDHLWFCAEAKLTRARDKEHQQQQRQQQQQQQQQRQRQQQQQQRRQQEPSWPALLASMGESSPAAQAHRLLSASSSPTLPPSPGDGGGGGGKGNRGKDDRGKALFLGNSAKPVWRLETCYPQGASSGQCFTVENADAVCARNWSRGAAGGDGQEVRSKHPTPLWNLSDFYLSFCNSYTLWELFSGLSSPNTLNCSLDVVLKEGGEMTTCRQCVEAYQDYDHHAQEKYEEFESVLHKYLQSEEYSVKSCPEDCKIVYKAWLCSQYFEVTQFNCRKTIPCKQYCLEVQTRCPFILPDNDEVIYGGLSSFICTGLYETFLTNDEPECCDVRREEKSNNPSKGTVEKSGSCHRTSLTVSSATRLCNSRLKLCVLVLILLHTVLTASAAQNTAGLSFGGINTLEENSTNEE

SEQ ID NO: 765389 - protein, 458 aa, Homo sapiens; identical to SEQ ID NO: 765388

SEQ ID NO: 765390 - protein, 458 aa, Homo sapiens; identical to SEQ ID NO: 765388

SEQ ID NO: 765391 - protein, 191 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765392 - protein, 151 aa, Homo sapiens
MLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLPLLSAYVGRLSARPKLKAFLASPEYVNLPINGNGKQ

SEQ ID NO: 765393 - protein, 184 aa, Homo sapiens
HASRTRGSTHASPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765394 - protein, 182 aa, Homo sapiens
KKPTTARYEASQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765395 - protein, 191 aa, Homo sapiens; identical to SEQ ID NO: 765391

SEQ ID NO: 765396 - protein, 147 aa, Homo sapiens
MLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765397 - protein, 173 aa, Homo sapiens
TRRGRVGRPTRRPRVAQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765398 - protein, 147 aa, Homo sapiens; identical to SEQ ID NO: 765396

SEQ ID NO: 765399 - protein, 144 aa, Homo sapiens
GYPLRSHQLEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVP

SEQ ID NO: 765400 - protein, 104 aa, Homo sapiens
NYTLSFRVHVHIVQVSYICIHVPCQCAAPTNSSSSIRYISQCYSLIYTNYEAGKDDYVKALPGQLKPFETLLSQNQGGKTFIVGDQISFADYNLLDLLLIHEVH

SEQ ID NO: 765401 - protein, 147 aa, Homo sapiens
MLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQRSPSLTTNSELVRYRARF

SEQ ID NO: 765402 - protein, 147 aa, Homo sapiens; identical to SEQ ID NO: 765396

SEQ ID NO: 765403 - protein, 179 aa, Homo sapiens
PGLQEFGTQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765404 - protein, 227 aa, Homo sapiens
GFGILVVGNKSSRVSVFSSFFAKLMESIKASTAFNCASVGAYFLLFFKDENMYCRKSSMKGSCTTPRSISKYEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765405 - protein, 259 aa, Homo sapiens
AARVPGDGAQSSQHGANPQHQARAPGRPPRPPRDPGRGPRGPRTSPVPLAAFRGPGAPRGGMGPRGRGGGAGCAHRALASSPGLQQTFLCSLQCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765406 - protein, 173 aa, Homo sapiens; identical to SEQ ID NO: 765397

SEQ ID NO: 765407 - protein, 168 aa, Homo sapiens
VRGWCESAEDSQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765408 - protein, 191 aa, Homo sapiens; identical to SEQ ID NO: 765391

SEQ ID NO: 765409 - protein, 191 aa, Homo sapiens; identical to SEQ ID NO: 765391

SEQ ID NO: 765410 - protein, 191 aa, Homo sapiens; identical to SEQ ID NO: 765391

SEQ ID NO: 765411 - protein, 191 aa, Homo sapiens; identical to SEQ ID NO: 765391

SEQ ID NO: 765412 - protein, 144 aa, Homo sapiens; identical to SEQ ID NO: 765399

SEQ ID NO: 765413 - protein, 147 aa, Homo sapiens
SLECSPHPAGCTEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVH

SEQ ID NO: 765414 - protein, 191 aa, Homo sapiens; identical to SEQ ID NO: 765391

SEQ ID NO: 765415 - protein, 105 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGES

SEQ ID NO: 765416 - protein, 200 aa, Homo sapiens
MPPYTVVYFPVRGRCAALAHAAGRSGPELEGGGGDRGDVAGGLTQSLLPIRAAPQVPGRRPHPVPVQYHPASPGPHPWLGLTDSPLVGPSPVTVCVIRRPVTRPAPLHPTPGLYGKDQQEAALVDMVNDGVEDLRCKYISLIYTNYEAGKDDYVKALPGQLKPFETLLSQNQGGKTFIVGDQISFADYNLLDLLLIHEVP

SEQ ID NO: 765417 - protein, 191 aa, Homo sapiens; identical to SEQ ID NO: 765391

SEQ ID NO: 765418 - protein, 112 aa, Homo sapiens
SSIQVRSRLTCTVQYILRPWPHSWLYGKDQQEAALVDMVNDGVEDLRCKYISLIYTNYEAGKDDYVKALPGQLKPFETLLSQNQGGKTFIVGDQISFADYNLLDLLLIHEVP

SEQ ID NO: 765419 - protein, 191 aa, Homo sapiens; identical to SEQ ID NO: 765391

SEQ ID NO: 765420 - protein, 191 aa, Homo sapiens; identical to SEQ ID NO: 765391

SEQ ID NO: 765421 - protein, 191 aa, Homo sapiens; identical to SEQ ID NO: 765391

SEQ ID NO: 765422 - protein, 90 aa, Homo sapiens
HLTRNLTLTAYPNLRMVNDGVEDLRCKYISLIYTNYEAGKDDYVKALPGQLKPFETLLSQNQGGKTFIVGDQISFADYNLLDLLLIHEVH

SEQ ID NO: 765423 - protein, 212 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQGEHLAPCCSFLATLCFQMDTGISFADYNLLDLLLIHEVH

SEQ ID NO: 765424 - protein, 205 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQGEHLAPCCSFLATLCFQMDTGVSHLFSKAEQT

SEQ ID NO: 765425 - protein, 68 aa, Homo sapiens
GRDESRMIHGGVWQEAGKDDYVKALPGQLKPFETLLSQNQGGKTFIVGDQISFADYNLLDLLLIHEVH

SEQ ID NO: 765426 - protein, 84 aa, Homo sapiens
ISVSYVQYHWWTIDLIGQGGIEDSVLTNYEEAGKDDYVKALPGQLKPFETLLSQNQGGKTFIVGDQISFADYNLLDLLLIHEVP

SEQ ID NO: 765427 - protein, 195 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLPLLSAYVGRLSARPKLKAFLASPEYVNLPINGNGKQ

SEQ ID NO: 765428 - protein, 105 aa, Homo sapiens; identical to SEQ ID NO: 765415

SEQ ID NO: 765429 - protein, 160 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYPPALSICGAPQCPAQAQGLPGLP

SEQ ID NO: 765430 - protein, 141 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGLYGKDQQEAALVDMVNDGVEDLRCKYISLIYTNYRRKG

SEQ ID NO: 765431 - protein, 82 aa, Homo sapiens
GRDESRMIHGGVWQEAGKDDYVKALPGQLKPFETLLSQNQGGKTFIVGDQGEHLAPCCSFLATLCFQMDTGVSHLFSKAEQT

SEQ ID NO: 765432 - protein, 167 aa, Homo sapiens
IRGRVDTADEKLQKGGVSPPQSSPPCRPTPWSISQFEAAARPWRMLLADQGQSWKEEVVTVETWQEGSLKASCLYGQLPKFQDGDLTLYQSNTILRHLGRTLGFYGKDQQEPQGVHMLDVGMQHPRSRENSLMYTIEDPRTDSYLMPSWPFRRLRIRWSVGRHKGNL

SEQ ID NO: 765433 - protein, 119 aa, Homo sapiens [sequence omitted]

SEQ ID NO: 765434 - protein, 275 aa, Homo sapiens
MLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 765435 - protein, 117 aa, Homo sapiens
MLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAD

SEQ ID NO: 765436 - protein, 117 aa, Homo sapiens; identical to SEQ ID NO: 765435

SEQ ID NO: 765437 - protein, 275 aa, Homo sapiens; identical to SEQ ID NO: 765434

SEQ ID NO: 765438 - protein, 554 aa, Homo sapiens
WAPARRWGGAGRGGARSRSEWGRPPGRGHCRPAPRFPTRLRRRTPLTEAMEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 765439 - protein, 268 aa, Homo sapiens
WAPARRWGGAGRGGARSRSEWGRPPGRGHCRPAPRFPTRLRRRTPLTEAMEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEGLD

SEQ ID NO: 765440 - protein, 177 aa, Homo sapiens
SPCCEIPACCPELSLPIRGTKVSGREVDRKGSSSAVPPSSPSFALSRPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 765441 - protein, 554 aa, Homo sapiens; identical to SEQ ID NO: 765438

SEQ ID NO: 765442 - protein, 214 aa, Homo sapiens
SCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDELCFR

SEQ ID NO: 765443 - protein, 309 aa, Homo sapiens
SCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 765444 - protein, 214 aa, Homo sapiens; identical to SEQ ID NO: 765442

SEQ ID NO: 765445 - protein, 214 aa, Homo sapiens; identical to SEQ ID NO: 765442

SEQ ID NO: 765446 - protein, 227 aa, Homo sapiens
MSHHTRTLGVVLSPQQGAPAGPGGGLGTPYHSHPCKPRQVPVSESQPPPHTMQVGRWAGLGVGQAEATSVRLGLHGLEPVFPYLGHDLQGPAVSHGDGLAGVGRELALLLGGPEQRGAKHRAKVVQGHLIDCLLLCHPVEDRSRGCCFNATTRREAEGLCRARVLREGVTSTLAVLQADSSLGVSSTRRTAAGGAARAAADGQSSPRATPATTPSPGSPRQGRLSME

SEQ ID NO: 765447 - protein, 102 aa, Homo sapiens [sequence omitted]

SEQ ID NO: 765448 - protein, 101 aa, Homo sapiens
CHIKFNPPATDFTYAQNNTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 765449 - protein, 100 aa, Homo sapiens
PVGRIHRHLKTRTTSHGRVGATAAVHRAAIPGYLTAEVLELAGLWVIVALNVWLILSGSPFIDNSRNLLGPKCGRLQLPSPPQDPITSLFCLNSADSKVK

SEQ ID NO: 765450 - protein, 108 aa, Homo sapiens
FQSHFLLQSKDCNHPSSADKHSHQIHSYQLYTHPLLHPWDHRDPPRTDHHTHGHHVHNPPLLHSGDHPHLHSADHEGHHDKGHQFHVHPLLHSGDDLDPHRADHSSHY

SEQ ID NO: 765451 - protein, 376 aa, Homo sapiens
GGRPRGSERWDTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTPTASSTRATAGTLKVLTSTTTTPTVISSRATPSSSPGTATALPALRSTATTPTATSVTAIPSSSLGTAWTRLSQTTTPTATMSTATPSSTPETVHTSTVLTTTATTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGT

SEQ ID NO: 765452 - protein, 736 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 765453 - protein, 736 aa, Homo sapiens; identical to SEQ ID NO: 765452

SEQ ID NO: 765454 - protein, 736 aa, Homo sapiens; identical to SEQ ID NO: 765452

SEQ ID NO: 765455 - protein, 736 aa, Homo sapiens; identical to SEQ ID NO: 765452

SEQ ID NO: 765456 - protein, 361 aa, Homo sapiens
CLGNIARPLSPEKGKKKKKIDTIDLEEGRAQSGGELGGGGRGKMAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 765457 - protein, 291 aa, Homo sapiens
CLGNIARPLSPEKGKKKKKIDTIDLEEGRAQSGGELGGGGRGKMAAAAAAAAEQITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 765458 - protein, 257 aa, Homo sapiens
MCEGEEGLGWRPLSYFSTATITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 765459 - protein, 361 aa, Homo sapiens; identical to SEQ ID NO: 765456

SEQ ID NO: 765460 - protein, 361 aa, Homo sapiens; identical to SEQ ID NO: 765456

SEQ ID NO: 765461 - protein, 361 aa, Homo sapiens; identical to SEQ ID NO: 765456

SEQ ID NO: 765462 - protein, 398 aa, Homo sapiens
CLGNIARPLSPEKGKKKKKIDTIDLEEGRAQSGGELGGGGRGKMAAAAAAAAEQQSSNGPVKKSMREKAVERRSVNKEHNSNFKAGYIPIDEDRLHKTGLRGRKGNLAICVIILLFILAVINLILPGSQARDRRAFSGIPDAYEKKDLKILSFGKSRGKSHITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 765463 - protein, 361 aa, Homo sapiens; identical to SEQ ID NO: 765456

SEQ ID NO: 765464 - protein, 361 aa, Homo sapiens; identical to SEQ ID NO: 765456

SEQ ID NO: 765465 - protein, 147 aa, Homo sapiens
CLGNIARPLSPEKGKKKKKIDTIDLEEGRAQSGGELGGGGRGKMAAAAAAAAEQQSSNGPVKKSMREKAVERRSVNKEHNSNFKAGYIPIDEDRLHKTGLRGRKGNLAICVIILLFILAVINLIVSICKNTHFNCHGEFFICFIVKS

SEQ ID NO: 765466 - protein, 183 aa, Homo sapiens
FNKWCWENWLAKCRKLKLDPFLTPYTKINSRWIKDLNVRPKTINTLEENLGNTIQDIGMGKDFMAETPKAMGTKVKIDRWDLIKLKSFCTAKETTIRVNRQPTKWEKIFAIYLSNKGLIPRIYNELKQIYKKKPHQQVGEGYEQTLLKRRHLCSQQTHEKMLIITGHQRNANQNHNEIPSHTS

SEQ ID NO: 765467 - protein, 56 aa, Homo sapiens
MKNDFDELREEGFRRSNYSELREDIQTKGKEVENFEKKLEECITRITNTEKCLKEL

SEQ ID NO: 765468 - protein, 492 aa, Homo sapiens
MGSCCSCLNRDSVPDNHPTKFKVTNVDDEGVELGSGVMELTQSELVLHLHRREAVRWPYLCLRRYGYDSNLFSFESGRRCQTGQGIFAFKCSRAEEIFNLLQDLMQCNSINVMEEPVIITRNSHPAELDLPRAPQPPNALGYTVSSFSNGCPGEGPRFSAPRRLSTSSLRHPSLGEESTHALIAPDEQSHTYVNTPASEDDHRRGRHCLQPLPEGQAPFLPQARGPDQRDPQVFLQPGQVKFVLGPTPARRHMVKCQGLCPSLHDPPHHNNNNEAPSECPAQPKCTYENVTGGLWRGAGWRLSPEEPGWNGLAHRRAALLHYENLPPLPPVWESQAQQLGGEAGDDGDSRDGLTPSSNGFPDGEEDETPLQKPTSTRAAIRSHGSFPVPLTRRRGSPRVFNFDFRRPGPEPPRQLNYIQVELKGWGGDRPKGPQNPSSPQAPMPTTHPARSSDSYAVIDLKKTVAMSNLQRALPRDDGTARKTRHNSTDLPL

SEQ ID NO: 765469 - protein, 74 aa, Homo sapiens
EGLAPGGRRLLQRDPGAGPGAARAAGRCEPQVYPRGIRVTSLQTVCHDSPPRTGGIKWEPFPMPLPRSAPRWPG

SEQ ID NO: 765470 - protein, 208 aa, Homo sapiens
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASRVLAALIVASVVGLAELYVMVRAMEGELGEL

SEQ ID NO: 765471 - protein, 208 aa, Homo sapiens; identical to SEQ ID NO: 765470

SEQ ID NO: 765472 - protein, 208 aa, Homo sapiens; identical to SEQ ID NO: 765470

SEQ ID NO: 765473 - protein, 208 aa, Homo sapiens; identical to SEQ ID NO: 765470

SEQ ID NO: 765474 - protein, 152 aa, Homo sapiens
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQGEVLGDQASKTFS

SEQ ID NO: 765475 - protein, 208 aa, Homo sapiens; identical to SEQ ID NO: 765470

SEQ ID NO: 765476 - protein, 208 aa, Homo sapiens; identical to SEQ ID NO: 765470

SEQ ID NO: 765477 - protein, 208 aa, Homo sapiens; identical to SEQ ID NO: 765470

SEQ ID NO: 765478 - protein, 199 aa, Homo sapiens
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASVSRHWAGQGALVGVLVGKGGRM

SEQ ID NO: 765479 - protein, 152 aa, Homo sapiens
NSFKALELRLVCGSPDTFSSALPLEPMIVMCFLTSWEYHSSHLIFLLQNPELVARLEKIKIQLANEEYKRITRNVTCQDTRHGGTLSDLGKQVRSLKALVITIFNFIVTVVAAFVCTYLGSQYIFTEMASVSRHWAGQGALVGVLVGKGGRM

SEQ ID NO: 765480 - protein, 151 aa, Homo sapiens
MLGLLSREPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 765481 - protein, 158 aa, Homo sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 765482 - protein, 227 aa, Homo sapiens
MEGSAVTVLERGGASSPAERRSKRRRRSGGDGGGGGGARAPEGVRAPAAGQPRATKGAPPPPGTPPPSPMSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 765483 - protein, 158 aa, Homo sapiens; identical to SEQ ID NO: 765481

SEQ ID NO: 765484 - protein, 156 aa, Homo sapiens
MGEATKDYIICWEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 765485 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 765486 - protein, 648 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKVRSEAKSVFIRRALGLLVSFLFLLVSNLHVANNDYY

SEQ ID NO: 765487 - protein, 315 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 765488 - protein, 109 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPGLPLSSTPGLEDRKM

SEQ ID NO: 765489 - protein, 307 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATSSAVGGGPMAEKPELFTGLPGSYIAEDLTGQPRGRAGVGTAGGSQGWGTL

SEQ ID NO: 765490 - protein, 315 aa, Homo sapiens; identical to SEQ ID NO: 765487

SEQ ID NO: 765491 - protein, 177 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLACLSPPPQA

SEQ ID NO: 765492 - protein, 224 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTLLS

SEQ ID NO: 765493 - protein, 254 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPGQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 765494 - protein, 306 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSTLGTQRDLGKGALEPGAPADSSRVPLSGARPRTVTQGLRSPLSLVLSYPPMSSQNPSLENSGGHSEGPPPQPWVVGPWQRSLNSLLGYQVHTLLRT

SEQ ID NO: 765495 - protein, 250 aa, Homo sapiens
GEKEEGRGERRELAPKWEKAASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEGKHPSHLSLGEASKAGFLEA

SEQ ID NO: 765496 - protein, 311 aa, Homo sapiens
MEPQPPLGPGTPARLCADPPVAPSPGLSSDHPCLHPPSFACSTNPGRVAGGGVRLLAPLQGQNTNLTVGGALRYPPPIKAIPTLKKKKKKKTKKKKKKKNTTKTTETKQRKRGPATRNNHTPLGGDPNELIGRKPQSYARTERRPPQTKSRCPQLHTTRQARARLDHTQVDAWGNTNDYRLPPSAAQATPLPRGRAQQRKAHSTEKSAHRGYITNISAASSAPHTANYAAPETPCTSHSIIKSNPAEKYKSDTQQKRRTYKRPARERNHSRNHAQQATHSRKHPTAEQLRPIRIRDSLRDNRTQTTITNNS

SEQ ID NO: 765497 - protein, 71 aa, Homo sapiens
IELGLILLTDLELDLSGHRSQVKFMDLRCSQGGWCLWIQFRSPRALTFITRPPSPTSNIRLGNPASYSHEE

SEQ ID NO: 765498 - protein, 324 aa, Homo sapiens
EASRGPLTPVTKDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGHKGEGE

SEQ ID NO: 765499 - protein, 205 aa, Homo sapiens
MTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRGIVKKHIIKPPRT

SEQ ID NO: 765500 - protein, 120 aa, Homo sapiens
QPVCLQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNS

SEQ ID NO: 765501 - protein, 351 aa, Homo sapiens
MTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGHKGEGE

SEQ ID NO: 765502 - protein, 199 aa, Homo sapiens
MTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRGKKQGFI

SEQ ID NO: 765503 - protein, 1184 aa, Homo sapiens
NSCHSSCNGPGAQSSTSDLLVMTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRTSNPLSLLASVHQLQGFTYTATAIQNVVHRLFHASYGARRDATKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDTDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAALAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 765504 - protein, 1170 aa, Homo sapiens
ISVPTVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRTSNPLSLLASVHQLQGFTYTATAIQNVVHRLFHASYGARRDATKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDTDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRLRAAFLRGSPGGPRFRWGCPPHVVLPGADGLSSARCSARRTRPVLWVGVSMQFIPAEIPRSAFECREQVVSEQTLVQSNICLYIDKRSKNLLGSRESPPLQPRTPWPLESPIPGPCLPPCSLSTQGVPVSTPSLRPPTGDLQSSVTLDLALDPGRLSPRATFQETKNRSLSRVRVLGLKAHCENFNLLLPSCVEDSVTPITLRLNFTLVGKPLLAFRNLRPMLAALAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 765505 - protein, 171 aa, Homo sapiens
NSCHSSCNGPGAQSSTSDLLVMTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQEMVLLCH

SEQ ID NO: 765506 - protein, 146 aa, Homo sapiens
AHHLGPVISTFPSTRPSPPWMLHDFIPFLPSRSHQMPIPAAALHPKGAGFPENEGLLFLAKVKKALLKNRQRGCSRWLTSVIPISQAELGVRCLHAGFCTAGLPRWATLLAGREERPLGRDMAPVRLQLTQPQGQKRPNHFYFLRL

SEQ ID NO: 765507 - protein, 127 aa, Homo sapiens
LCCLGWSQTPGLKQSSRLSLPKCWDSRCEPPHPDSTNISCLHTPENPTDRNPFHMDFKLLKSILQMRKLRLREGTQTCRSGSCAAASTLLPKVFFVSSQGGGWSPPKDNSCQPNGWPLPVWLQHWCL

SEQ ID NO: 765508 - protein, 755 aa, Homo sapiens
MNDTRVTRTPFLSPLLHLFLSNHLPTPTSSFQVLLGDICSQLTPSLPFRWSYLHIPLVTYFQLLPLLSILIHPSLLWPADRGLPALLQAAVFWAGTERGSRPHPGWTGGPGCGGPGPGAPAQVRAAFLRGSPGGPRFRWGCPPHVVLPGADGLSSARCSARRTRPVLWVGVSMQFIPAEIPRSAFECREQVVSEQTLVQSNICLYIDKRSKNLLGSRESPPLQPRTPWPLESPIPGPCLPPCSLSTQGVPVSTPSLRPPTGDLQSSVTLDLALDPGRLSPRATFQETKNRSLSRVRVLGLKAHCENFNLLLPSCVEDSVTPITLRLNFTLVGKPLLAFRNLRPMLAALAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 765509 - protein, 755 aa, Homo sapiens; identical to SEQ ID NO: 765508

SEQ ID NO: 765510 - protein, 48 aa, Homo sapiens
MDVEVSHPQVPKDCMWLLHECPFYLDSLCPMWVPDVPAETLVLCIFPQ

SEQ ID NO: 765511 - protein, 61 aa, Homo sapiens
DLQSSVTLDLALDPGRLSPRATFQETKNRSLSRVRVLGLKAHCENFNLLLPVRLGMNVGGG

SEQ ID NO: 765512 - protein, 480 aa, Homo sapiens
NSPQASPFKMHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 765513 - protein, 228 aa, Homo sapiens
MFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRFVVLPYFGYRTIATIEKEFRNWVQSCVCETGFSFFTAPTVWYPWEPCGLRHLGVSLPVIALGV

SEQ ID NO: 765514 - protein, 92 aa, Homo sapiens
CSAWTNLGSVSHLDQSHQGKGAACPHLWSCERPARPVAQRSGTVYGTMHTGQQVALMWPLEGWRRAHYRNRRRASSPLTQDVLGNALALSED

SEQ ID NO: 765515 - protein, 268 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 765516 - protein, 123 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 765517 - protein, 128 aa, Homo sapiens
RSSTGLERNDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 765518 - protein, 444 aa, Homo sapiens
MPNSFQEHLASRTGAFNSEKSRDPQETCTTAPAAALLGAGQGQLGWLPGRRDPPAPRRPAVSHGPLGTCSSEEGSARVSAPRPHRAPRAGGRRGPSPPPQEGVRGVPSGRREARGAAVAAARSRTPAAAAARLPLLCAAAARACAGPGARRPRALCVCCVCVCVCVCVRVCACESASVCARVSERRAGASVAAAEREQDPAGALPSLRLPAGTMSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQVPRSRSQRGSQIGREPIGLSGDLEGVPPSKKMKLEASQQNSEEM

SEQ ID NO: 765519 - protein, 372 aa, Homo sapiens
MPNSFQEHLASRTGAFNSEKSRDPQETCTTAPAAALLGAGQGQLGWLPGRRDPPAPRRPAVSHGPLGTCSSEEGSARVSAPRPHRAPRAGGRRGPSPPPQEGVRGVPSGRREARGAAVAAARSRTPAAAAARLPLLCAAAARACAGPGARRPRALCVCCVCVCVCVCVRVCACESASVCARVSERRAGASVAAAEREQDPAGALPSLRLPAGTMSGRSVRAETRSRAKDDIKRVMAAIEKVRKWEKKWVTVGDTSLRIYKWVPVTEPKVDDKNKNKKKGKDEKCGSEVTTPENSSSPGMMDMHGECPWPASLSCPARGLGQALGHVFVSPAGLFTFQARGRRAGQGPAASVPRRRVSGGEDVSFPSVPSQET

SEQ ID NO: 765520 - protein, 210 aa, Homo sapiens
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 765521 - protein, 434 aa, Homo sapiens
MTGPRATRDARCPTLSKSTSRPEPVPSTRRSQETRKKLARLHPPPRCWGLGRGSWAGSRGDATPPRPADRLSPMDPSAPAAPRKGQRACPHPAPTARPEPGVAVALRHLPRRASGASPLGDARPGGLRWPRRGAALRRRRRRGSPCSVQLPPGLALGQARGGPGLCVCVCVCVCVCVCVRVCACESASVCARVSERRAGASVAAAEREQDPAGALPSLRLPAGTMSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 765522 - protein, 356 aa, Homo sapiens
MTGPRATRDARCPTLSKSTSRPEPVPSTRRSQETRKKLARLHPPPRCWGLGRGSWAGSRGDATPPRPADRLSPMDPSAPAAPRKGQRACPHPAPTARPEPGVAVALRHLPRRASGASPLGDARPGGLRWPRRGAALRRRRRRGSPCSVQLPPGLALGQARGGPGLCVCVCVCVCVCVCVRVCACESASVCARVSERRAGASVAAAEREQDPAGALPSLRLPAGTMSGRSVRAETRSRAKDDIKRVMAAIEKVRKWEKKWVTVGDTSLRIYKWVPVTEPKVDDKNKNKKKGKDEKCGSEVTTPENSSSPGMMDMHAGLFTFQARGRRAGQGPAASVPRRRVSGGEDVSFPSVPSQET

SEQ ID NO: 765523 - protein, 210 aa, Homo sapiens; identical to SEQ ID NO: 765520

SEQ ID NO: 765524 - protein, 402 aa, Homo sapiens
GAAELGSSPPSGPLSTRALCWAMEPAPDAQEARTVREALGRYEAALEGAVRALHEDMRGLQRGVERRVAEAMRLAGPLARTVADLQRDNQRLQAQLERLTRQVEALGLASGMSPVPGTPGTPSPPPAPGVPDRAPRLGSARFASHATFSLSGRGQSLDHDEASESEMRKTSNSCIMENGHQPGAEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 765525 - protein, 402 aa, Homo sapiens; identical to SEQ ID NO: 765524

SEQ ID NO: 765526 - protein, 262 aa, Homo sapiens
GAAELGSSPPSGPLSTRALCWAMEPAPDAQEARTVREALGRYEAALEGAVRALHEDMRGLQRGVERRVAEAMRLAGPLARTVADLQRDNQRLQAQLERLTRQVEALGLASGMSPVPGTPGTPSPPPAPGVPDRAPRLGSARFASHATFSLSGRGQSLDHDEASESEMRKTSNSCIMENGHQPGAGPGDGPPEIAQNFSAPDPPRPRPVSLSLRLPHQPVTAITRVSDRFSGETSAAALSPMSAATLGGLNPSPSEVITPWTP

SEQ ID NO: 765527 - protein, 69 aa, Homo sapiens
PGVNRPRVASGISSLIHFHLSSPGNPMTNWPLAGALIRLQFLKRTSGGKSYTSGEVGLELLQYGGKGSS

SEQ ID NO: 765528 - protein, 477 aa, Homo sapiens
MLAENLVEEFEMKEDEPWYDHQDLQQDLQLAAELGKTLLDRNTELEDSVQQMYTTNQEQLQEIEEFTWQESYTFDTSMCCCYANHILYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 765529 - protein, 169 aa, Homo sapiens
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQ

SEQ ID NO: 765530 - protein, 454 aa, Homo sapiens
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 765531 - protein, 379 aa, Homo sapiens
MNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 765532 - protein, 110 aa, Homo sapiens
MSRRQELPLSGRFLNPNSRSTSSLPAGPGANLRVKMREGVAGRRTSGFRHPCASRRHEGLPWTTARLSEAGVLGPPACVACPQTRRPRDTHHRGKTRLCQLPSPKPRTPS

SEQ ID NO: 765533 - protein, 136 aa, Homo sapiens
DSCHSHHSLDRNHVISKNQVIYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765534 - protein, 99 aa, Homo sapiens
MEKLGNVESVYVIDPEDVALLFKSEGPNPERFLIPPWVAYHQYYQRPIGVLLKSRQPEKKDNHNLIERRRRFNINDRIKELGTLIPKSSDPEMRWNKGT

SEQ ID NO: 765535 - protein, 521 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765536 - protein, 450 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKVGAASRLQALPVREGWGRLELQTEGGTGALVGPLMAAV

SEQ ID NO: 765537 - protein, 544 aa, Homo sapiens
FPGLHEFGTSLKWSRYSHSCGDSMLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765538 - protein, 498 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMPEKPISFTFWPFNQEATQQ

SEQ ID NO: 765539 - protein, 502 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILQ

SEQ ID NO: 765540 - protein, 641 aa, Homo sapiens
MSLHSRPGQQKRNSVSKKKKKKKSGEGDLKVRAQSEKVAAWSSLALATDPAFLPAHAAARAALFRNWVRPSVAPGLLLRSSRVAHLRLPSTQPEPIRPPGRPAFTSGRGPGARPRGGGGGPPQFLGPSHSAAKFPNTDSVRFEVLRGRWSTGFAGPARRRRRTGSDPVCVSLPGLRPCSIHSSPLLASALARCVHPSSPEPTGADSGALREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765541 - protein, 443 aa, Homo sapiens
RHEDGSVTEREGEKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765542 - protein, 469 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYRKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765543 - protein, 301 aa, Homo sapiens [sequence omitted]

SEQ ID NO: 765544 - protein, 370 aa, Homo sapiens
ETLRLHPISVTLQRYLVNDLVLRDYKIPAKTLVQVAIYCSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765545 - protein, 521 aa, Homo sapiens; identical to SEQ ID NO: 765535

SEQ ID NO: 765546 - protein, 521 aa, Homo sapiens; identical to SEQ ID NO: 765535

SEQ ID NO: 765547 - protein, 495 aa, Homo sapiens
MLAKGLPPRSVLVKGCQTFLSAPREGLGRLRVPTGEGAGISTRSPRPFNEIPSPGDNGWLNLYHFWRETGTHKVHLHHVQNFQKYGPIYREKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINQCESSWGHLGTLGWPWP

SEQ ID NO: 765548 - protein, 450 aa, Homo sapiens; identical to SEQ ID NO: 765536

SEQ ID NO: 765549 - protein, 537 aa, Homo sapiens
MRFSARPAALQHPLLASAGLCPRSLRSPELTRAHRSRQWRAKQRCETGTVFVSILQKRKLRLRGVKGLDSGPTVSKLWNCEAAVLSLYPELSSDPSISPSPPPLQGEKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765550 - protein, 443 aa, Homo sapiens
SQDEPGEGISQGEKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765551 - protein, 391 aa, Homo sapiens
MRTDSLTNQRYRKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 765552 - protein, 160 aa, Homo sapiens
CISQNLSLLFNDVCLYSGAITKTYVAQAGKIALTFSWAPHFPQTQVVCSLDQWLPGHGLRCRGQWEAPAQAKAQADISGSLLGLALRAETEGSPCPLENLTLQKFQTEPSYRVGEELSAGLSLQQEEGREHFISFWYGLELVVIILALVAQGYSHPSSPR

SEQ ID NO: 765553 - protein, 109 aa, Homo sapiens
MWKPMPSPSNMKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 765554 - protein, 106 aa, Homo sapiens
EKPFCRSCEAWILVQIPGIWNPWKNHCPVLGLGFPIYIMSTLCNHRTSKVRGNGGGCYFIINKDGKWLSAVAHACNPSTLGGRGRKITYGSEFKTILANMAKPRLY

SEQ ID NO: 765555 - protein, 212 aa, Homo sapiens
DVLENLEDPRSGPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGVTRRLKRYMIT

SEQ ID NO: 765556 - protein, 413 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPEKSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 765557 - protein, 252 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDHATALHPGQHK

SEQ ID NO: 765558 - protein, 243 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRSVGKVSKHFKVSDLPACAFRVTLLSIFTAG

SEQ ID NO: 765559 - protein, 284 aa, Homo sapiens
MAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 765560 - protein, 205 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGVTRRLKRYMIT

SEQ ID NO: 765561 - protein, 128 aa, Homo sapiens
SSRLECSGMISAHCSLRLPGSSDSPASPSRVAGITGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 765562 - protein, 420 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 765563 - protein, 420 aa, Homo sapiens; identical to SEQ ID NO: 765562

SEQ ID NO: 765564 - protein, 284 aa, Homo sapiens; identical to SEQ ID NO: 765559

SEQ ID NO: 765565 - protein, 124 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRRTLDLSIVSGYILEGEVFIVGSVMNQLENCLLQYVLG

SEQ ID NO: 765566 - protein, 131 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCRGEHCVSCC

SEQ ID NO: 765567 - protein, 93 aa, Homo sapiens
GEGTNLKDKQKETLAGGELGESVKGMALTRNQRNAPCSLIFLAPKHTAWELVEDTTFRFSELLRVCVSNKLSLLPAWGPHLETKNCVCCFSHL

SEQ ID NO: 765568 - protein, 99 aa, Homo sapiens
LVLEVSIAKVENEVDRSIQKVYKTYNGTNPDAASRAIDYVQRQLHCCGIHNYSDWENTDWFKETKNQSVPLSCCRETASNCNGSLAHPSDLYAEVSLLA

SEQ ID NO: 765569 - protein, 325 aa, Homo sapiens
LPGSGAGALRGLRRLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 765570 - protein, 325 aa, Homo sapiens; identical to SEQ ID NO: 765569

SEQ ID NO: 765571 - protein, 325 aa, Homo sapiens; identical to SEQ ID NO: 765569

SEQ ID NO: 765572 - protein, 325 aa, Homo sapiens; identical to SEQ ID NO: 765569

SEQ ID NO: 765573 - protein, 325 aa, Homo sapiens; identical to SEQ ID NO: 765569

SEQ ID NO: 765574 - protein, 325 aa, Homo sapiens; identical to SEQ ID NO: 765569

SEQ ID NO: 765575 - protein, 92 aa, Homo sapiens
QCWYRLGVMDIVDPRRSAARRSEALAGVGAARRRRGCGERRAGRAVPSEEAPPPLPLSRGQLAFYAMWEPMSSSLMMTMTTSLKMCTRSSLL

SEQ ID NO: 765576 - protein, 274 aa, Homo sapiens
LPGSGAGALRGLRRLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQGCEALVVKKLQEIMMHVIWAALAFAAIQLLGMLCACIVLCRRSRDPAYELLITGGTYA

SEQ ID NO: 765577 - protein, 99 aa, Homo sapiens
MSGQAQWLTPVIPALWEAEAGGSRGQDIETILAHPSDLYAEGCEALVVKKLQEIMMHVIWAALAFAAIQLLGMLCACIVLCRRSRDPAYELLITGGTYA

SEQ ID NO: 765578 - protein, 219 aa, Homo sapiens
LPGSGAGALRGLRRLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLWV

SEQ ID NO: 765579 - protein, 171 aa, Homo sapiens
SAGTGWGLWISSTHGARLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATVRCVVRTCRSI

SEQ ID NO: 765580 - protein, 117 aa, Homo sapiens
SAGTGWGLWISSTHGARLRGGARRLLGSGLRDGAGAAGSAAQAVQFLARRRRRHCRSLGERSPALRAGPSRATGAMGQCGITSSKTVLVFLNLIFWPIWTLHPDKSFKTFPLSHHLI

SEQ ID NO: 765581 - protein, 325 aa, Homo sapiens; identical to SEQ ID NO: 765569

SEQ ID NO: 765582 - protein, 328 aa, Homo sapiens
SAGTGWGLWISSTHGARLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 765583 - protein, 325 aa, Homo sapiens; identical to SEQ ID NO: 765569

SEQ ID NO: 765584 - protein, 325 aa, Homo sapiens; identical to SEQ ID NO: 765569

SEQ ID NO: 765585 - protein, 325 aa, Homo sapiens; identical to SEQ ID NO: 765569

SEQ ID NO: 765586 - protein, 313 aa, Homo sapiens
LPGSGAGALRGLRRLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHLLGMLCACIVLCRRSRDPAYELLITGGTYA

SEQ ID NO: 765587 - protein, 325 aa, Homo sapiens; identical to SEQ ID NO: 765569

SEQ ID NO: 765588 - protein, 325 aa, Homo sapiens; identical to SEQ ID NO: 765569

SEQ ID NO: 765589 - protein, 325 aa, Homo sapiens; identical to SEQ ID NO: 765569

SEQ ID NO: 765590 - protein, 97 aa, Homo sapiens
IGPLRKIGPLRKIVPLSCCRETASNCNGSLAHPSDLYAEGCEALVVKKLQEIMMHVIWAALAFAAIQLLGMLCACIVLCRRSRDPAYELLITGGTYA

SEQ ID NO: 765591 - protein, 130 aa, Homo sapiens
FIFRVNISHPHYYFCDNQEQDDDRGKSTATFPDCGTAANEPNDEKQGSYSYDHYSRDERVHIFKEVVIVIIKGCEALVVKKLQEIMMHVIWAALAFAAIQLLGMLCACIVLCRRSRDPAYELLITGGTYA

SEQ ID NO: 765592 - protein, 300 aa, Homo sapiens
LPGSGAGALRGLRRLRGGARRLLGSGLRDGAGAAGSAAQAVQFLARRRRRHCRSLGERSPALRAGPSRATGAMGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQFAEEPHWPPSLTGPVMPVRNVYKKEKARVITEEEKNFKAFASLRMARANARLFGIRAKRAKEAAEQDVEKKKYSPPGDLESVGS

SEQ ID NO: 765593 - protein, 156 aa, Homo sapiens
PWKGVVTFRCCHHCGKLTWCCWVCLMERCFHCFPVHLVFNLVQSFSPTSGVESCLLPQCDKCWPMVYRSCDASRGLVNACILGFVLLECSFVGALNNYVRSLATLLERTHGGKRLKLCEESQASHPSFSAEPRHQPTCQLNATVRVITSKITRKTT

SEQ ID NO: 765594 - protein, 116 aa, Homo sapiens
KLLSHSAKEHYQTQFPISQQNHSPVTDYPTQFHWGSQMARVCLKCKSLSPTLREASGAVEYALNTSGTNSCANGCTWTYTTLGLWAPFVPAAPSVLKTGALLFSSCESCCPASPSH

SEQ ID NO: 765595 - protein, 622 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 765596 - protein, 521 aa, Homo sapiens
MKENVASATVFTLLLFLNTCLLNVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 765597 - protein, 521 aa, Homo sapiens; identical to SEQ ID NO: 765596

SEQ ID NO: 765598 - protein, 589 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSAWWTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 765599 - protein, 118 aa, Homo sapiens
LNSLPCHLRTSGGGNFPSVCELMFLCQAIQPCYIFLHSFPPILSFTLSKEQQSVANTQNKVVDVPDQTAISQKLPATFSSSELLIHFLQQEKAANMKENVASATVFTLLLFLNTCLLN

SEQ ID NO: 765600 - protein, 193 aa, Homo sapiens [sequence omitted]

SEQ ID NO: 765601 - protein, 349 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQEREQRQAQEARDS

SEQ ID NO: 765602 - protein, 230 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSAW

SEQ ID NO: 765603 - protein, 262 aa, Homo sapiens
YIRTKTYECNICEKIFKQPIHLTEHMRIHTGEKPFRCKECGRAFSQSASLSTHQRIHTGEKPFECEECGKAFRHRSSLNQHHRTHTGEKPYVCDKCQKAFSQNISLVQHLRTHSGEKPFTCNECGKTFRQIRHLSEHIRIHTGEKPYACTACCKTFSHRAYLTHHQRIHTGERPYKCKECGKAFRQRIHLSNHKTVHTGVKAYECNRCGKAYRHDSSFKKHQRHHTGEKPYECNECGKAFSYNSSLSRHHEIHRRNAFRNKV

SEQ ID NO: 765604 - protein, 145 aa, Homo sapiens
PRCTYHHLIPYILICTVNMSSTKVRQDDGRDDICCIHCYLTTTWLIVEIPECYCYKCTVSAYMSKITHSKARCGGSCLQFPALWKVEEGGSLEVRSSRPAWLTWRNPISTETTKISWAWWRVPVIPATQDAEAGELLKPGRQRLQ

SEQ ID NO: 765605 - protein, 124 aa, Homo sapiens
FNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 765606 - protein, 101 aa, Homo sapiens
MAWSLSRSPAHLPTTPCPTHREGGGSTGCFEQSSCLYLEPVLTVLGAGISQEGYCVFPCLFLFLECELFQNELKIIHLHPSALSIEVCTEYMLSKCLTDIK

SEQ ID NO: 765607 - protein, 271 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLARGH

SEQ ID NO: 765608 - protein, 405 aa, Homo sapiens
MNAGKQLQRTLHNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDG

SEQ ID NO: 765609 - protein, 622 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQQYCPPMFLDSLTSPLTASSTSVTTTSSHESSTHVSSSSSRSETGVITSSGSNIPDIISLD

SEQ ID NO: 765610 - protein, 553 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPENKV

SEQ ID NO: 765611 - protein, 572 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 765612 - protein, 349 aa, Homo sapiens
SESSRNLARADIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQQYCPPMFLDSLTSPLTASSTSVTTTSSHESSTHVSSSSSRSETGVITSSGSNIPDIISLD

SEQ ID NO: 765613 - protein, 282 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLGKCLRIHKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 765614 - protein, 572 aa, Homo sapiens; identical to SEQ ID NO: 765611

SEQ ID NO: 765615 - protein, 622 aa, Homo sapiens; identical to SEQ ID NO: 765609

SEQ ID NO: 765616 - protein, 622 aa, Homo sapiens; identical to SEQ ID NO: 765609

SEQ ID NO: 765617 - protein, 572 aa, Homo sapiens; identical to SEQ ID NO: 765611

SEQ ID NO: 765618 - protein, 507 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGFVNL

SEQ ID NO: 765619 - protein, 290 aa, Homo sapiens
STFYATSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQQYCPPMFLDSLTSPLTASSTSVTTTSSHESSTHVSSSSSRSETGVITSSGSNIPDIISLD

SEQ ID NO: 765620 - protein, 259 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPVPLVQGRQQLIVGLVGW

SEQ ID NO: 765621 - protein, 144 aa, Homo sapiens
DDKGEMLWFKRGKSLLPILSVSSPNTSSSSSSLEYASSSSSSPGSVGSLLTGHSPFGCKTLLSFGLSQLFSWSLLSDILLDSDDEWLRETEVIGVFTTKLDSPPRFTSAFGIWVIPSGCSAELEVLALPFKKAKPAGKESPFST

SEQ ID NO: 765622 - protein, 66 aa, Homo sapiens
QYQDFLEDLEEDEAIRKNVNIYRDSAIPVESDTDDEGAPRISLAEMLEDLHISQDATGEEGASMLT

SEQ ID NO: 765623 - protein, 190 aa, Homo sapiens
RTRGSAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765624 - protein, 136 aa, Homo sapiens
AESAGTAWISSARGRDGGAGGTRSGAGTHPLAARVLDRFAQFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765625 - protein, 165 aa, Homo sapiens
GRKKSAWVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765626 - protein, 129 aa, Homo sapiens
KKKMQFCSPSARSVRPRGGSLAAGRCCHLFLFPQFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765627 - protein, 193 aa, Homo sapiens
AESAGTAWISSARGRDGGAGGTRSGAGTHPLAARVLDRFAQVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765628 - protein, 155 aa, Homo sapiens
RTRGSAELRVPGGAKHGMCLLLGATGVGKTLLVKRLQEVSSRDGKGDLGEPPPTRPTVGTFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 765629 - protein, 174 aa, Homo sapiens
RTRGSAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKMLPDIIACAKQNITTAEISAREGTGLAGVLAWLQATHRAND

SEQ ID NO: 765630 - protein, 739 aa, Homo sapiens
RGGAWAKRPAGGGGGRSVLLFPAAAVADPARQALLTVASSGPRSPALASAPAPGPQPSSQPRPPAAAMSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 765631 - protein, 605 aa, Homo sapiens
ARYEAGWLIRPRVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 765632 - protein, 385 aa, Homo sapiens
MFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 765633 - protein, 739 aa, Homo sapiens; identical to SEQ ID NO: 765630

SEQ ID NO: 765634 - protein, 225 aa, Homo sapiens
LTARYEAGVWEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 765635 - protein, 739 aa, Homo sapiens; identical to SEQ ID NO: 765630

SEQ ID NO: 765636 - protein, 464 aa, Homo sapiens
RGGAWAKRPAGGGGGRSVLLFPAAAVADPARQALLTVASSGPRSPALASAPAPGPQPSSQPRPPAAAMSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGYLGSWRLLQNQPQDRGHRHAWPE

SEQ ID NO: 765637 - protein, 171 aa, Homo sapiens
RLGSEAGWAYFSNIPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 765638 - protein, 228 aa, Homo sapiens
RGGAWAKRPAGGGGGRSVLLFPAAAVADPARQALLTVASSGPRSPALASAPAPGPQPSSQPRPPAAAMSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGMYNSVQRMNLYL

SEQ ID NO: 765639 - protein, 100 aa, Homo sapiens
RPVGKGLRVSVGTACFAEEAKACVGRKITAGPQPQRAGSRTEGAPRCTLQPPAREKQQETELLPLTQWWFLTPKTSWTIGSEQQSLQFALFCSRETTRIK

SEQ ID NO: 765640 - protein, 376 aa, Homo sapiens
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGNHREDGVALKGSHSLLPSRVRSTAFLSRLGFLLTEPPQGLRGAPLRGACSPGAEITEEVVTWTTRGRIFPGLCTRTGGARRGGP

SEQ ID NO: 765641 - protein, 417 aa, Homo sapiens
MKFPLSLTIMNSGLWSCLLLVCQIEVLMLSAMSDHISKQHHRMKFKQCRCSDTGLCCLDHEGKAEVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGNHREDGVALKGSHSLLPSRVRSTAFLSRLGFLLTEPPQGLRGAPLRGACSPGAEITEEVVTWTTRGRIFPGLCTRTGGARRGG

SEQ ID NO: 765642 - protein, 365 aa, Homo sapiens
KVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGNHREDGVALKGSHSLLPSRVRSTAFLSLSGIPLTEPPQGLRGAPLRGACSPGAEITEEVVTWTTRGRIFPGLCTRTGGARRGGP

SEQ ID NO: 765643 - protein, 203 aa, Homo sapiens
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASQAQLFGLEMEDRPHRLLIMKDPYTLCKAELKIV

SEQ ID NO: 765644 - protein, 126 aa, Homo sapiens
EEAATKKERKGVTGKEPTGTTPMQQEELRGWDRTGQGRGEGATGMELVQPSHNQPLPGALAARRAPRWALWSVLSRSPPHRPSDAPFQRLERGGRPRIASSAVSPAPRTATTQCPTLPDAGGRWRP

SEQ ID NO: 765645 - protein, 101 aa, Homo sapiens
AAGCFVTRRHGDKDRVPGSSAPAKGCWPRRRLNLAGAGMGCREQRNVALILWMPYFYIICTVLAVSFPDHCLVCFLRKAKREEIEEKVDFQLQTFIHLLSA

SEQ ID NO: 765646 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 765647 - protein, 253 aa, Homo sapiens; identical to SEQ ID NO: 765646

SEQ ID NO: 765648 - protein, 249 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAK

SEQ ID NO: 765649 - protein, 266 aa, Homo sapiens
MALSMPLNGLKEEDKEPLIELFVKVNLKFGLSGYIGKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 765650 - protein, 211 aa, Homo sapiens
MILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 765651 - protein, 119 aa, Homo sapiens
MRKGTSIAWNSPKPEYFLGSVDKIPDKDHLSEEKNFKESCLFDRDLREQLTTIDKETLQGAAKPDAHFRTMPCGQLLHFLQRNTIIAAVSGVAILMAIVLLLLGLASYIRKKQPSDMYS

SEQ ID NO: 765652 - protein, 319 aa, Homo sapiens
SEDWLLHDGLWTKAKMSRAMALFFVLCWIQVEMGFHHVGQAGHELLTINGSSCLSFLSSWDHRCTPPRPDEIVLQVFSKVPYDPSFDETRTAVRSITKRDTQKSYSQQKSLNNAAFASGSNEREEHLAKIFDEILLQVFPKFPYDPSFNEATAVRSITKTDMRKGTSIAWNSPKPEYFLGSVDKIPDKDHLSEEKNFKESCLFDRDLREQLTTIDKETLQGAAKPDAHFRTMPCGQLLHFLQRNTIIAAVSGVAILMAIVLLLLGLASYIRKKQPSSPLANTTYNIFIMDGKTWWHNSEEKNFTKLAKKQKQLKSSSCV

SEQ ID NO: 765653 - protein, 458 aa, Homo sapiens
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 765654 - protein, 458 aa, Homo sapiens; identical to SEQ ID NO: 765653

SEQ ID NO: 765655 - protein, 168 aa, Homo sapiens
MKRPFSKEDIDAANKHMKKCSSSLAIREMQIKTTMRYHFTPVRMAIIKKSGNNRCWRGCGEIGTLLHCWWDCKLIQPLWKSVWRFLRDLELEIPFDPAIPLLGIYPKDYKSCCYKDTCTHMFIAALFTIAKTWNQPKCPTMIDWIKKMWHIYTMEYYGAIKRMSSCPL

SEQ ID NO: 765656 - protein, 115 aa, Homo sapiens
LLHCAGDGGGLWAWAPRLGGGSRLEVDVKLWLPGGGGRAVETVAWETYPLLRSENRAPEPHAAQVWGSSRVNCRLQVRHPHAHALPLPLRDPRDPSSGTRAESSASSREVWARQA

SEQ ID NO: 765657 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 765658 - protein, 311 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDR

SEQ ID NO: 765659 - protein, 195 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKV

SEQ ID NO: 765660 - protein, 970 aa, Homo sapiens [sequence omitted]

SEQ ID NO: 765661 - protein, 970 aa, Homo sapiens [sequence omitted]

SEQ ID NO: 765662 - protein, 938 aa, Homo sapiens
MATCIGEKIEDFKVGNLLGKGSFAGVYRAESIHTGLEVAIKMLYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPTFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRDRASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 765663 - protein, 743 aa, Homo sapiens [sequence omitted]

SEQ ID NO: 765664 - protein, 317 aa, Homo sapiens
RRAQPATFIPRVAVKMALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765665 - protein, 317 aa, Homo sapiens; identical to SEQ ID NO: 765664

SEQ ID NO: 765666 - protein, 321 aa, Homo sapiens
RGALLGTLSAKEYAVVESGMALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765667 - protein, 349 aa, Homo sapiens
RGALLGTLSAKEYAVVEIRDGAGGFCASPGARSAPRGRNPGWAGIGPGPGPGPGTNGLPHAAFAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765668 - protein, 305 aa, Homo sapiens
PGKRAAARGEAGGRRAAVSAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765669 - protein, 310 aa, Homo sapiens
LLGRAWVESAEGLCASPWRAFCSGTGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765670 - protein, 317 aa, Homo sapiens
MMFEASLFYFIRGLMFIVVTVQMAGDSVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765671 - protein, 295 aa, Homo sapiens
MVRGRVLCSGGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765672 - protein, 319 aa, Homo sapiens
VKMAACGFLVLMLLCCCCSCSCCCVVPCVSLCAAVPSCAVLELWRAWLCSGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765673 - protein, 306 aa, Homo sapiens
RGALLGTLSAKEYAVVESGMALVASVRVPARVLLRAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765674 - protein, 300 aa, Homo sapiens
RRAQPATFIPRVAVKMALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 765675 - protein, 257 aa, Homo sapiens [sequence omitted]

SEQ ID NO: 765676 - protein, 69 aa, Homo sapiens
ETQLGIIAQWMAIPDHARQLTKAMMRKATASRLVTQRDADVQNFVSFISKDSIQKSLQMYLERLKEEKG

SEQ ID NO: 765677 - protein, 90 aa, Homo sapiens
MLITTAILRPQMLGLLVENTENPPQYPRVIGSVGRVSNQFPFTGKPYHRVRLGKFWPGHTLALFKGLWVGPSLQQPISGFGRESPAILSQ

SEQ ID NO: 765678 - protein, 1235 aa, Homo sapiens
YLAMANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPPSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLAAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 765679 - protein, 945 aa, Homo sapiens
RVGDKLVPCHPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLAAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 765680 - protein, 1262 aa, Homo sapiens
YLAMANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPPSGTPQKAKFSIGSDEDDSPGLPGRAAVTKPLPSVGPHTDKSPQHSSRPCSELRDGDGTTDLALSSPRLLCCLPSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLAAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 765681 - protein, 604 aa, Homo sapiens
DLVLGVTRVDRTSIINIDHWGDGYNAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLAAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 765682 - protein, 135 aa, Homo sapiens
MGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 765683 - protein, 1210 aa, Homo sapiens
YLAMANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPPSGTPQKAKFSIGSDEDDSPGLPGRAAVTKPLPSVGPHTDKSPQHSSRPCSELRDGDGTTDLALSSPRLLCCLPSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLAAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGESPPPPCTPPSLGPTVLHLHYPRLDPESPNVLCVALNLTPKPASQHSPSPLLLESFSGSLSCPLFSLFFFETESRSVTQAGVQWRDL

SEQ ID NO: 765684 - protein, 898 aa, Homo sapiens
YLAMANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPPSGTPQKAKFSIGSDEDDSPGLPGRAAVTKPLPSVGPHTDKSPQHSSRPCSELRDGDGTTDLALSSPRLLCCLPSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETLGIDTWASGRAQPWAGGLLRTQRCAWNHS

SEQ ID NO: 765685 - protein, 83 aa, Homo sapiens
LRDALHSQCVAAVLFIYFAALSPAITFGGLLGKGLGLGELRGSSSHFWSQCHLQDSGSGCDHIRGPMVRCASKGVSTLQRCWI

SEQ ID NO: 765686 - protein, 121 aa, Homo sapiens
ALVVHPTPGQCPSFPAVDDGGSRCSRPPRPHPDLHGDTDHGVREMGGGGGRDEAKLLGSLAWFQGYSRDIIISIRVLGGGSWWQSLRKRVCVEELAGVRRRWGRSREQWHPGQGHGFPVMV

SEQ ID NO: 765687 - protein, 190 aa, Homo sapiens
GQEFGTRGVWGGDMLGCGIPALGLLLLLQGSADGNGIQGFFYPWSCEGDIWDRESCGGQAAIDSPNLCLRLRCCYRNGVCYHQRPDENVRRKHMWALVWTCSGLLLLSCSICLFWWAKRRDVLHMPGFLAGPCDMSKSVSLLSKHRGTKKTPSTGSVPVALSKESRDVEGGTEGEGTEEGEETEGEEEED

SEQ ID NO: 765688 - protein, 171 aa, Homo sapiens
MPPQSSLGCDSFCLSLFSMTLTVWREVLGKYFVDCAQLRFGSCFSQGLAPVKKRRNFPVKQWGKNDPFPLGPLKGMEPFFGPDSKGAFPSKTRMFPFGFSWKQKRKPWAGPRAGSRSYGLSPASPHPRPTSWAYYRLPSSLQSPGNRALSHSDPHQTCSAPGMIGWGGAAI

SEQ ID NO: 765689 - protein, 194 aa, Homo sapiens
MAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765690 - protein, 192 aa, Homo sapiens
IGRRPGWPSEAAGGAGRAVRTAGASLPRRRPCPRDLTAGSEGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765691 - protein, 209 aa, Homo sapiens
AGVTVQPAGSGSSRAGPAGHGQCGGAEAAGGAGRAVRTAGASLPRRRPCPRDLTAGSEGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765692 - protein, 213 aa, Homo sapiens
HEGRKAASATQLFTLRWATMAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765693 - protein, 209 aa, Homo sapiens; identical to SEQ ID NO: 765691

SEQ ID NO: 765694 - protein, 216 aa, Homo sapiens
PGAARPGGGPGVRGAGEAGAAGMAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765695 - protein, 143 aa, Homo sapiens
MRRALIPPCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIF

SEQ ID NO: 765696 - protein, 256 aa, Homo sapiens
NNSKDDVGNPLVNPKGANGAAGGPQMAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWRPCPTRFCPGRASQPLPEGVEAFTRTHCVEGSRAVRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765697 - protein, 209 aa, Homo sapiens; identical to SEQ ID NO: 765691

SEQ ID NO: 765698 - protein, 143 aa, Homo sapiens; identical to SEQ ID NO: 765695

SEQ ID NO: 765699 - protein, 206 aa, Homo sapiens
AGVTVQPAGSGSSRAGPAGHGQCGGAEAAGGAGRAVRTAGASLPRRRPCPRDLTAGSEGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLDAAAALLVGSARGGAAAQCRAASDHTGCSSSGGGGRVHQQGSG

SEQ ID NO: 765700 - protein, 190 aa, Homo sapiens
KARYEGWVGGEAAGGAGRAVRTAGASLPRRRPCPRDLTAGSEGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLDAAAALLVGSARGGAAAQCRAASDHTGCSSSGGGGRVHQQGSG

SEQ ID NO: 765701 - protein, 194 aa, Homo sapiens; identical to SEQ ID NO: 765689

SEQ ID NO: 765702 - protein, 194 aa, Homo sapiens; identical to SEQ ID NO: 765689

SEQ ID NO: 765703 - protein, 209 aa, Homo sapiens; identical to SEQ ID NO: 765691

SEQ ID NO: 765704 - protein, 113 aa, Homo sapiens
NNSKDDVGNPLVNPKGANGAAGGPQMAKQKRKVPEVTEKKNKKLKKASAEGPLLGPEAAPSGEGAGSKGEAVLRPGLDAEPELSPEEPIPLRGPHSWSPACVHRGAWLWPVFL

SEQ ID NO: 765705 - protein, 209 aa, Homo sapiens; identical to SEQ ID NO: 765691

SEQ ID NO: 765706 - protein, 209 aa, Homo sapiens; identical to SEQ ID NO: 765691

SEQ ID NO: 765707 - protein, 219 aa, Homo sapiens
NNSKDDVGNPLVNPKGANGAAGGPQMAKQKRKVPEVTEKKNKKLKKASAEGPLLGPEAAPSGEGAGSKGEAVLRPGLDAEPELSPEEQRVLERKLKKERKKEERQRLREAGLVAQHPPARRSGAELALDYLCRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765708 - protein, 209 aa, Homo sapiens; identical to SEQ ID NO: 765691

SEQ ID NO: 765709 - protein, 143 aa, Homo sapiens; identical to SEQ ID NO: 765695

SEQ ID NO: 765710 - protein, 143 aa, Homo sapiens; identical to SEQ ID NO: 765695

SEQ ID NO: 765711 - protein, 168 aa, Homo sapiens
MDALDKVVQEREDALRLLQTGQERARPGAWRRDIFGRIIWHKFKQWVIPWHLNKRYNRKRFLALPYAIAYGKAKSGTAHLRRWAQKHKNWRFQKTRQTWLLLHMYDSDKVPDEHFSTLLAYLEGLQGRARELTVQKAEALMRELDEEGSDPPLPGRAQRIRQVLQLLS

SEQ ID NO: 765712 - protein, 151 aa, Homo sapiens
KARYEGWVGGEAAGGAGRAVRTAGASLPRRRPCPRDLTAGSEALIPPCLGRAQRILTGAAAALLVGSARGGAAAQCRAASDHTEGPGKEAEKGTEERGEAASAGGRPCGPAPACQALGGRTGPGLPLQMGPKAQELEVSEDEADVAPAAHV

SEQ ID NO: 765713 - protein, 194 aa, Homo sapiens; identical to SEQ ID NO: 765689

SEQ ID NO: 765714 - protein, 209 aa, Homo sapiens; identical to SEQ ID NO: 765691

SEQ ID NO: 765715 - protein, 163 aa, Homo sapiens
MGQKAQDWRFQQDEADVGSCCTCITSDKGPDEHFINLVATGGLQAGREVTVRRRSPMRTDKRAESTCREGQGLETCGRVKTCTLSANSGTRWVRHPVPHVATRGRGRGYFAPQGFWFGGPRGRWQTPLTKPGANTARENESKESRGDDLAHPLCTGSGGVSRE

SEQ ID NO: 765716 - protein, 807 aa, Homo sapiens
VCVPLRTGYCLPRAPVGFCVPTFNPNCGSRGSRTGRRGATGHSWLCLGPCTAPQPVAPPTVPKEYGPPEEGPAWTVILRSSSTEPRQAVQSLCPPRPGDAEAGAEAQVGPGGAAPPASLQAPLVGPTVAPVESPPYRLPGMTHVAGRTDAFQTQLDPGAAFLGPTHPISPGLTPLHTASIHGWGAKPPPPTQPPGCRMSPGKALMGACGPGKEHGSLARGQRHLPQPLASSHQLTGPEVSDETPTGAREGWKSQFVRHNWDSHSLGPWDPGTLRQSRRGPAWADGGWGQGGSASLCLPSSSDEYQAARATLLRAFQAKFDTFVVPCVVASGDIKDRKGSEPLSFRCGVLWPEQGVVSRKRAVPLLLPNSGAWAGRGPPTLPSACPSYPSPHNTLYLELWCPTVAPSVVVTSHKGKTIFNFGDVAVGHRSIKKISIQNVSPEDLALDFSLLNPNGPFVLLNHSSLLRAGGTQVLVLSFSPHESILAQETLDIITKRGTLTLTLMGTGVASMITCSIEGSVLNMGYVIAGESVSSGFKLQNNSLLPIKFSMHLDSLSSTRGRGQQQLPQFLSSPSQRTEVVGTQNLNGQSVFSVAPVKGVMDPGKTQDFTVTFSPDHESLYFSDKLQVVLFEKKISHQILLKGAACQHMMFVEGGDPLDVPVESLTAIPVFDPRHREASSRPGPLSPEAEELRPILVTLDYIQFDTDTPAPPATRELQVGCIRTTQPSPKKTVEFSIDSVASLQHKGFSIEPSRGSVERGQTKTISISWVPPADFDPDHPLMVSALLQLRGDVKETYKVIFVAQVLTGP

SEQ ID NO: 765717 - protein, 520 aa, Homo sapiens
VCVPLRTGYCLPRAPVGFCVPTFNPNCGSRGSRTGRRGATGHSWLCLGPCTAPQPVAPPTVPKEYGPPEEGPAWTVILRSSSTEPRQAVQSLCPPRPGDAEAGAEAQVGPGGAAPPASLQAPLVGPTVAPVESPPYRLPGMTHVAGRTDAFQTQLDPGAAFLGPTHPISPGLTPLHTASIHGWGAKPPPPTQPPGCRMSPGKALMGACGPGKEHGSLARGQRHLPQPLASSHQLTGPEVSDETPTGAREGWKSQFVRHNWDSHSLGPWDPGTLRQSRRGPAWADGGWGQGGSASLCLPSSSDEYQAARATLLRAFQAKFDTFVVPCVVASGDIKDRKGSEPLSFSPHNTLYLELWCPTVAPSVVVTSHKGKTIFNFGDVAVGHRSIKKISIQNVSPEDLALDFSLLNPNGPFVLLNHSSLLRAGGTQVLVLSFSPHESILAQETLDIITKRGTLTLTLMGTGVASMITCSIEGSVLNMGYVIAGESVSSGFKVKHTWALVLAPASQEGFPPGRTQASCQK

SEQ ID NO: 765718 - protein, 473 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765719 - protein, 388 aa, Homo sapiens
MAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765720 - protein, 283 aa, Homo sapiens [sequence omitted]

SEQ ID NO: 765721 - protein, 704 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKCACGPFALPGPSSSSQHPSHWGCHPLWPPHYLLRWVGKEHRPRVRQLHPEASGKGLGLLGPQFTRVQNEGVEGIRGFPPWLPWGTCGGGRVPPHSPGLRIGGRPGGPRCPPTPREHPAGAPCWHCGPSALALHSSGTVASPPLWLIVPFQGWWDGEGFRGAPAGTRGGLHGVSEVCLPPGDGLLPSQSLGRFFPLTRGQVWLSCCYLEQEAQRGRVGSLGCAPLTFSTYPRYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765722 - protein, 294 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRHFLRSGAAGGGVRVRPGGPAERLAAF

SEQ ID NO: 765723 - protein, 100 aa, Homo sapiens
IRARYPIGEGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765724 - protein, 407 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGGHQRCPWRAARVGRGPWAPPALTP

SEQ ID NO: 765725 - protein, 221 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQVLGNGVHTQLHPSCLCERGDL

SEQ ID NO: 765726 - protein, 83 aa, Homo sapiens
QYTRTSPTSVGRALGVYQAEACPAAPRRRASRHHEEILSGVQGRHQVQERGTRSEAQRVRGGKGPQREAQPASPQAAPPGTHQ

SEQ ID NO: 765727 - protein, 388 aa, Homo sapiens; identical to SEQ ID NO: 765719

SEQ ID NO: 765728 - protein, 150 aa, Homo sapiens
MKIYTFNKDQDRVKLGVDTIAKYLDNIHLHPEEEKYRKIKLQNKVFQERITCWKDHELGAWVQKGASARSGDPEKSTCRVEHLGQQRLERPDTWVRTGAKEGGRFNPPGRGAGIHQRERRKPPRGGPDTERGGTTGPAENGGGRPPAGGD

SEQ ID NO: 765729 - protein, 231 aa, Homo sapiens
MCGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765730 - protein, 100 aa, Homo sapiens
GRGGSTHASRTFYARERLGAVYGFVREALQSDWLPFELLASGGQKLSEDENLALNECGLVPSALLTFSWDMAVLEDIKAAGAEPDSILKPELLSAIEKLL

SEQ ID NO: 765731 - protein, 82 aa, Homo sapiens
FFFRWLVSGGPVPDWAPCPPAPAAPRRRASRHHEEILSGVQGRHQVQERGTRSEAQRVRGGKGPQREAQPASPQAAPPGTHQ

SEQ ID NO: 765732 - protein, 144 aa, Homo sapiens
FSSGGWSPAAPSPTGPRAPPPPRPPAAGPAATMKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVTPTNLSPP

SEQ ID NO: 765733 - protein, 66 aa, Homo sapiens
RLPAEFPAAARADSRSQSDGLPLPQVPSALLTFSWDMAVLEDIKAAGAEPDSILKPELLSAIEKLL

SEQ ID NO: 765734 - protein, 849 aa, Homo sapiens
METFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTTTATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTTATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPTVLGLRA

SEQ ID NO: 765735 - protein, 849 aa, Homo sapiens; identical to SEQ ID NO: 765734

SEQ ID NO: 765736 - protein, 730 aa, Homo sapiens
AATLRIPITCIVLTTTATTPTVTSSKATPSSSPGTATALPALRSTATTPTATSVTPIPSSSLGTTWTRLSQTTTPTATMSTATPSSTPETAHTSTVLTTTATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTTATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPTVLGLRA

SEQ ID NO: 765737 - protein, 251 aa, Homo sapiens
TWRPLHRENSYNSVTRKTGRPFSHRKTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPTVLGLRA

SEQ ID NO: 765738 - protein, 659 aa, Homo sapiens
METFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTTTATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTTATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPELLAPHM

SEQ ID NO: 765739 - protein, 322 aa, Homo sapiens
MRYDTLRENSFAYSRRHDEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPTVLGLRA

SEQ ID NO: 765740 - protein, 218 aa, Homo sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 765741 - protein, 218 aa, Homo sapiens; identical to SEQ ID NO: 765740

SEQ ID NO: 765742 - protein, 218 aa, Homo sapiens; identical to SEQ ID NO: 765740

SEQ ID NO: 765743 - protein, 106 aa, Homo sapiens
MRQWVGEVGWGPWRSAFEEVSPGRWTEDAWHGLLTGTPGGPGHGHSLPSFGVWAGTRSGDFLKGLGGGEGIVNGGIFSLRQKIFKGKIIFLVCCFRRPIKTVFSYV

SEQ ID NO: 765744 - protein, 328 aa, Homo sapiens
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKFLQVSTVTCARFSP

SEQ ID NO: 765745 - protein, 377 aa, Homo sapiens
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKT

SEQ ID NO: 765746 - protein, 324 aa, Homo sapiens
HKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKFLQVSTVTCARFSP

SEQ ID NO: 765747 - protein, 69 aa, Homo sapiens
PFTSLGSDEAPPTATTPVLLQAIVTGVPRHPGHRPSLGCTCSLPSCPRAELCTDHSALRQDDNTPQCFP

SEQ ID NO: 765748 - protein, 89 aa, Homo sapiens
TWSEPGGGGSRTEPSSQEVPGVSRGEAIVSKTARRGMQEKEPVPPSWGPPRKDVGFSQERGNRGSYSKKVYNPTQVVFRVGVDCGGETL

SEQ ID NO: 765749 - protein, 213 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEFDSWVLTFGLWVNLKPSA

SEQ ID NO: 765750 - protein, 972 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 765751 - protein, 972 aa, Homo sapiens; identical to SEQ ID NO: 765750

SEQ ID NO: 765752 - protein, 972 aa, Homo sapiens; identical to SEQ ID NO: 765750

SEQ ID NO: 765753 - protein, 972 aa, Homo sapiens; identical to SEQ ID NO: 765750

SEQ ID NO: 765754 - protein, 932 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTIFTGRCTDAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 765755 - protein, 724 aa, Homo sapiens
NAEYEPAVKFGSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 765756 - protein, 859 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVEVSFCSLPKRHCCS

SEQ ID NO: 765757 - protein, 589 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDVSEKLFFNCDLVC

SEQ ID NO: 765758 - protein, 109 aa, Homo sapiens
MSILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQVE

SEQ ID NO: 765759 - protein, 620 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 765760 - protein, 646 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQKCGICAAFCALRGDWCPGFLNGMTRLLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 765761 - protein, 306 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQVEYTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 765762 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 765763 - protein, 597 aa, Homo sapiens; identical to SEQ ID NO: 765762

SEQ ID NO: 765764 - protein, 432 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDIFQRRDYI

SEQ ID NO: 765765 - protein, 546 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVELSLALGTEPGTQRCPSVSGRPPKAVNKCSQAKDSCSVSQTQRM

SEQ ID NO: 765766 - protein, 102 aa, Homo sapiens
MGFYISQPEVCHFRLNLCNQDSVYLTWLPEPGLRCTLFPTPGASSSSFPDLLVQMPPSSCRATGHPWPAVVSLLPAIKGREILKFNLRTPCYLVKKFLNYFL

SEQ ID NO: 765767 - protein, 182 aa, Homo sapiens
LRSLAFLLSLPLADSSPLGSRSAGHQSRRPCPTELKARPGLVRGVRPSPPPGSAPAPTRTSGSAAAGRDRAGSKACGEAQDGRVGCHDVGPPDLEPCPAQGEQRAYGPGAGAAVRESLPAGPGAFAGPPGGFPWTFNGDSARPPDFLMQAFSYMTFFEARFSKDILKVAFLISCLTGWRSSS

SEQ ID NO: 765768 - protein, 182 aa, Homo sapiens; identical to SEQ ID NO: 765767

SEQ ID NO: 765769 - protein, 182 aa, Homo sapiens; identical to SEQ ID NO: 765767

SEQ ID NO: 765770 - protein, 182 aa, Homo sapiens; identical to SEQ ID NO: 765767

SEQ ID NO: 765771 - protein, 182 aa, Homo sapiens; identical to SEQ ID NO: 765767

SEQ ID NO: 765772 - protein, 182 aa, Homo sapiens; identical to SEQ ID NO: 765767

SEQ ID NO: 765773 - protein, 182 aa, Homo sapiens; identical to SEQ ID NO: 765767

SEQ ID NO: 765774 - protein, 71 aa, Homo sapiens
KFYFLILPAGPGAFAGPPGGFPWTFNGDSARPPDFLMQAFSYMTFFEARFSKDILKVAFLISCLTGWRSSS

SEQ ID NO: 765775 - protein, 182 aa, Homo sapiens; identical to SEQ ID NO: 765767

SEQ ID NO: 765776 - protein, 114 aa, Homo sapiens
PLQDRFWSQEQLSSPPEETASSPPTHSGLPNGTLTSSVGLYYTYIYIYIYIYIILEFVSHNTEYIVATLYLGLDSLSETPDFTFSLEGAGTYISQSSFLRILPSCPISATSDTS

SEQ ID NO: 765777 - protein, 114 aa, Homo sapiens; identical to SEQ ID NO: 765776

SEQ ID NO: 765778 - protein, 114 aa, Homo sapiens; identical to SEQ ID NO: 765776

SEQ ID NO: 765779 - protein, 114 aa, Homo sapiens; identical to SEQ ID NO: 765776

SEQ ID NO: 765780 - protein, 148 aa, Homo sapiens
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 765781 - protein, 161 aa, Homo sapiens
EGAGRQCVPGVLADRFELWLCLLAVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 765782 - protein, 82 aa, Homo sapiens
GHLSFFSHLDCKMKLLVLAVLLTVAAADSGISPRAVWQFRKMIKCVIPGSDPFLEYNNYGCYCGLGGSGTPVDELDKQKQRV

SEQ ID NO: 765783 - protein, 148 aa, Homo sapiens; identical to SEQ ID NO: 765780

SEQ ID NO: 765784 - protein, 148 aa, Homo sapiens; identical to SEQ ID NO: 765780

SEQ ID NO: 765785 - protein, 386 aa, Homo sapiens
PYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 765786 - protein, 229 aa, Homo sapiens
MFAIQPGLAEGGQFLGDPPPGLCQPELQPDSNSNFMASAKDANENWHGMPGRVEPILRRSSSESPSDNQAFQAPGSPEEGVRSPPEGAEIPGAEPEKMGGAGTVCSPLEDNGYASSSLSIDSRSSSPEPACGTPRGPGPPDPLLPSVAQAVQHLQVQERYKEQEKEKHHVHLVMYRRLALLQWIRGLQHQLIDQQARLQESFDTILDNRKELIRCLQQRAAPSRPQDQA

SEQ ID NO: 765787 - protein, 229 aa, Homo sapiens; identical to SEQ ID NO: 765786

SEQ ID NO: 765788 - protein, 134 aa, Homo sapiens
MLTRIGMGCQAEWNDNGYASSSLSIDSRSSSPEPACGTPRGPGPPDPLLPSVAQAVQHLQVQERYKEQEKEKHHVHLVMYRRLALLQWIRGLQHQLIDQQARLQESFDTILDNRKELIRCLQQRAAPSRPQDQA

SEQ ID NO: 765789 - protein, 116 aa, Homo sapiens
GDLQIISFSSYNLHSPRTALFVRLLELHTSGLNFTSASISARLSNLILPGPLLNASGSGLLFLANIFFSLLLVEPSQQTCIWQSWDIECGGWGEHVTSLESDGPRVDFWKSSVGWF

SEQ ID NO: 765790 - protein, 41 aa, Homo sapiens
MVTLSHLSCWAFPGYHPGAWSGCMCAWRPPEDPATHHWCCL

SEQ ID NO: 765791 - protein, 642 aa, Homo sapiens
MSGVGDQPGQRGESLSLLKIQKLAGRGGGRLESQLLRRLRQENHLNLGGRGCSEPRLHHCTPAWVTETLSQKKKKRKKERKKIGDEENSKVGISRNCVQMHPVVALQEVCLMKLGKHFAIFPLAVFLCSLLPLFFPWFVIIRREVLQRLVAVKESFLIFILESVTFIPGSHADLLIQSQLTRFILPSSWKTVCMNWSNRTEIHLNSDSSTSQGGGHISLCPTLSNFSEIRGGRVFPSGKWGESLQIVEMKYRIREKEKSVIEIDHFIEIRVDFYFNYSGEFNKRHYLKSFSNIDLGFFFLEWTHYIYKQLFCYSDFLLSENEIICFTFQSFVKQLEVIGRKAISNSAGQTKVWEILLTSHNTECLNMRIEFHDVVVPFNSGHHPNLMFSCYPKTVEGNWVFGRLLNHGLCQFESEILTSIYYKNRDLIQIAQYISKVNTFLKWNFLPSASTHSRSEAEYFKIELRSVSDGKVIFKNLDFIPVSGWVLSSFGPGKGPSSHSCPKSPSLSLPARLSAVWKEKGEEDGNGPTLQAEKELLGGLRRGRGKAVGVCWGWYPSAFPSPQPEKSIRLLFKAFEPALARTKHVRLEMLLLIAGVLIENIYDVGWGGRRQVVVMQENLVLKIYEFGGKGWDSQAKSVIILK

SEQ ID NO: 765792 - protein, 322 aa, Homo sapiens
MCSKNEEVQEASARSDKVTLLADISICLCWILTPQDSAAKKPSRGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERAC

SEQ ID NO: 765793 - protein, 46 aa, Homo sapiens
KRCDLNFLFIMSGGENRNENEESTSKAETSEDSASRGETTGRSQKE

SEQ ID NO: 765794 - protein, 395 aa, Homo sapiens
DAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYESLICSWSEKQRQCIGKPHKVILPGHPPPPSLPPPPRPGDTTSHADVAPLHLGPIVVGMDHTDGEAPGAALKMDEMRGVLWVGGAAYTRHQNISCVMTWGCNGGLTAQSDRCLAFPSTRCGKAPTCCKIMGP

SEQ ID NO: 765795 - protein, 476 aa, Homo sapiens
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 765796 - protein, 476 aa, Homo sapiens; identical to SEQ ID NO: 765795

SEQ ID NO: 765797 - protein, 377 aa, Homo sapiens [sequence omitted]

SEQ ID NO: 765798 - protein, 542 aa, Homo sapiens
GGSRAPTQHGQLLIVGHKVALVIHDWLLIFPTAPASPPVHLGRRPRRLGRRSWRSNKPGADPRHHRMERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 765799 - protein, 452 aa, Homo sapiens
MAAIELFSSYKKHEMETWEVSVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 765800 - protein, 236 aa, Homo sapiens
RELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPYILLAWGALHLLGCRKSLLTSLGPTTQSVAARGAHEGDSMHHRHFPSRVCVPAPCQAPE

SEQ ID NO: 765801 - protein, 240 aa, Homo sapiens
RELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPTMYGYFEPGRRK

SEQ ID NO: 765802 - protein, 146 aa, Homo sapiens [sequence omitted]

SEQ ID NO: 765803 - protein, 453 aa, Homo sapiens
MSIVTVQLGQCGNQIGFEVFDALLSDSHSSQGLCSMRENEAYQASCKERFFSEEENGVPIARAVLVDMEPKVINQTLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGDLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 765804 - protein, 418 aa, Homo sapiens [sequence omitted]

SEQ ID NO: 765805 - protein, 334 aa, Homo sapiens [sequence omitted]

SEQ ID NO: 765806 - protein, 238 aa, Homo sapiens
MRQSGASQPLLINMYLPDPVGDGLFKDGKNPSWGPLSPAVQKGSGQIQLWQFLLELLADRANAGCIAWEGGHGEFKLTDPDEVARRWGERKSKPNMNYDKLSRALRYYYDKNIMSKVHGKRYAYRFDFQGLAQACQPPPAHAHAAAAAAAAAAAAQDGALYKLPAGLAPLPFPGLSKLNLMAASAGVAPAGFSYWPGPGPAATAAAATAALYPSPSLQPPPGPFGAVAAASHLGGHYH

SEQ ID NO: 765807 - protein, 214 aa, Homo sapiens
RLVGLGVNRPRGAEPRGFSSGQIQLWQFLLELLADRANAGCIAWEGGHGEFKLTDPDEVARRWGERKSKPNMNYDKLSRALRYYYDKNIMSKVHGKRYAYRFDFQGLAQACQPPPAHAHAAAAAAAAAAAAQDGALYKLPAGLAPLPFPGLSKLNLMAASAGVAPAGFSYWPGPGPAATAAAATAALYPSPSLQPPPGPFGAVAAASHLGGHYH

SEQ ID NO: 765808 - protein, 130 aa, Homo sapiens
EEELKIFNRAQPEFPIALSTEILLEVCRSMSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 765809 - protein, 158 aa, Homo sapiens
YLSFRTAVPRCPLQASGLEGQPGIKRAGEVQESLATETQPEFPIALSTEILLEVCRSMSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 765810 - protein, 130 aa, Homo sapiens; identical to SEQ ID NO: 765808

SEQ ID NO: 765811 - protein, 128 aa, Homo sapiens
ENYLPLEGYLFPESYLPRALPAPRELTVPRGLPVHRELLASRGLLASRELPVPRGLPAYRGLPVPRELLCLESYLPSEGYPPSECYLSSLLLLSLGLSTCTLEPISFHLFRIKQDMVKKTLLMKNITF

SEQ ID NO: 765812 - protein, 528 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKGENWALQFLMGCSCHPGEPLQTVLAHLAALAPVCQPSGDRFWGTWTDAATSSRGWMMLRSQAQHVLLSGSPGPEVIAVEEVGTGCSPDLPPPSRAEMGRNPWDSPCPARSLPQIAAVARPRISSPMALSPDMLGAQGLWTHSIQGSLPAIWAATMGTKGGSRVLFPCHLSKALPHPDSGPHPAQDSGLWSRAHFPLSLGLGLTSGGHLTGGWSQPGNIVAGAVPRALPSQRDMENGVEGGPFPSRCGNSSELFWAKCGPSRQPQPCSAGDADRTREEAMLSLGTCCSMCPKPSCFPDGPSGNHLSRASAPLGARWVCINGVWVEPGGPSPARLKEGSSRTHRPGGKRGRLAGGSADTVRSPADSLSTSSFQSVKSISNSGEQAGVHVLTGVSAPRGPQPGWPLGVLTRYPLLGQAPGFGDEGAAEKSPAS

SEQ ID NO: 765813 - protein, 380 aa, Homo sapiens [sequence omitted]

SEQ ID NO: 765814 - protein, 314 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 765815 - protein, 467 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKRGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKWKSHRHGDSGAALQPGPQGGSGEGSVAAQKRSSLRPLCAPVRAMQAALPTHSTREDAHGDSPSTRPQPASEPTCGGACHPARTEADPEEQLCREAEEAAGNAETAPASLGALSYPHLVSARPTNLQLEIGSL

SEQ ID NO: 765816 - protein, 139 aa, Homo sapiens
MGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 765817 - protein, 287 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKRGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTCF

SEQ ID NO: 765818 - protein, 290 aa, Homo sapiens
MNQTSQKKDGPSGNHLSRASAPLGARWVCINGVWVEPGGPSPARLKEGSSRTHRPGGKRGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 765819 - protein, 122 aa, Homo sapiens
LSEAPRHNLTPFVHTPGPSLDGWGGVFSPPLNPRSIEGRLKQKVQRAPCVSAAFLTTQVLLFSSEEERGAFVQQLWDFCVRWALGLHVAEMSEKELFRKAVTKQQRERILEIFFRHLFAQVP

SEQ ID NO: 765820 - protein, 293 aa, Homo sapiens
WRDTWLRMPAFLPPPGGGGDGPGGPEPGWVDPRTWLSFQGPPGGPGIGPGVGSGSEVWGIPPCPPLYEFCGGMAYCGPQVGVRLVPQGGLETSQPEGEAGVRVESNSDGTSLEPCTVPPGAVKLEKEKLEQNPQESQNIKALQKELEQFAKLLKQKRITLGYTQADVGLTLGVLFGKVFSQTTICRFEGLQLSFKNMCKLRPLLQKWVEEADNNENLQETCKAETLLQARKRKRTSIENRVRGNLENLFLQCPKPTLQQISHIAQQLGLEKDVVRVWFCNRCQKGKQSSSDYA

SEQ ID NO: 765821 - protein, 65 aa, Homo sapiens
MDPTSNSTNLQKGLGSLVYSSLQSMLFLVPFCLFQPHVLLSRPHPQNWHFLQPSQSVLPHEESEG

SEQ ID NO: 765822 - protein, 235 aa, Homo sapiens
MAKTYDYLFKLLLIGDSGVGKTCLLFRFSEDAFNTTFISTIVRPHKRNKNNPFYYPTKCLLMKQCDVVEQSIGFGITVTYSTVVLGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFLHWHEIYDKPQRKMIDQHSPGAGGPGKLQ

SEQ ID NO: 765823 - protein, 260 aa, Homo sapiens
TGRGAQAFSERRGGAWGGASSGGLAGTPPRPRPPPRLSPPPPLAPRSEGRSEKMAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMNDSNSAGAGGPVKITENRSKKTSFFRCSLL

SEQ ID NO: 765824 - protein, 260 aa, Homo sapiens; identical to SEQ ID NO: 765823

SEQ ID NO: 765825 - protein, 260 aa, Homo sapiens; identical to SEQ ID NO: 765823

SEQ ID NO: 765826 - protein, 571 aa, Homo sapiens
MSTIFKLDTFSKGKDNFLETSYYSLFPEKIQAVNAFWMVTKYLLKDKCYDTMYECNSLSNLPLTIWCLNALVYIISGVVCKPKLTYSVVSFYYFVFLTECFALVIFLLSSFVLYGLITSLHELHLKEPVKVKMSLKVLFEVAANWEYMLCYIEINCPCYFLTFSFAEIVYTLSYDLRKFTFCMIKVTQINIPLCLIMYIQCIIFSICEMNLMTIIVCSPLKLKKSSFFVNIFVVLWIRYMKIFAAVLVVQWLHFIISVLIFDSDWTRPFQIESEEYQTVKMCCNYVACKSVDCKTFRWELILAIFYFRQIMINNLPVHQLVGAAGFLTIYRNILCSLCYKFSEDYTLYFEGLFFNYTSFSYTSILIPGRKTVSQPLSIYQNLDSLFCFELKTSLGKVGNISLGYEHTCHIQLHKKSIISLSPLINLAVQYRCVFAEVSSKRLELHFTGSECSESILRLIKFFLCSVSDTFKQTFFSSSRLRFLYKFSSQSLKTTFHYVGYIIINFKHSFLQSGFSEFFFFKQKRHSFFLVTSKGGTGVGGKECLKMKSLDIEGPRRTGYAKIISNSSTILE

SEQ ID NO: 765827 - protein, 260 aa, Homo sapiens; identical to SEQ ID NO: 765823

SEQ ID NO: 765828 - protein, 260 aa, Homo sapiens; identical to SEQ ID NO: 765823

SEQ ID NO: 765829 - protein, 253 aa, Homo sapiens
TGRGAQAFSERRGGAWGGASSGGLAGTPPRPRPPPRLSPPPPLAPRSEGRSEKMAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMNDSNSAGAGGPVKITVSERLQHT

SEQ ID NO: 765830 - protein, 260 aa, Homo sapiens; identical to SEQ ID NO: 765823

SEQ ID NO: 765831 - protein, 268 aa, Homo sapiens
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 765832 - protein, 174 aa, Homo sapiens
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAA

SEQ ID NO: 765833 - protein, 268 aa, Homo sapiens; identical to SEQ ID NO: 765831

SEQ ID NO: 765834 - protein, 285 aa, Homo sapiens
SSVLDRFKQKKPGFSYGGNHWSEIQLFSAPIERVRCPAFMVTPFLYLIISGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 765835 - protein, 268 aa, Homo sapiens; identical to SEQ ID NO: 765831

SEQ ID NO: 765836 - protein, 268 aa, Homo sapiens; identical to SEQ ID NO: 765831

SEQ ID NO: 765837 - protein, 268 aa, Homo sapiens; identical to SEQ ID NO: 765831

SEQ ID NO: 765838 - protein, 116 aa, Homo sapiens
AAAYYYYTARIQASNDVRGHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 765839 - protein, 400 aa, Homo sapiens
MGVLMSKRQTVEQVQKVSLAVSAFKDGLRDRPSIRRTGELPGSRRGTVEGSVQEVQEEKEAEAGTSVVQEESSAGRAAWERLRDGRGVEPEEFDRTSRFTPPAFIRPTRKLDDDKPPEICLEPREPVVNDEMCDVCEVWTAESLFPCRVCTRVFHDGCLRRMGYIQGDSAAEVTEMAHTETGWSCHYCDNINLLLTEEEMYSLTETFQRCKVIPDCSLTLEDFLRYRHQAAKRGDRDRALSEEQEEQAARQFAALDPEHRGHIEWPDFLSHESLLLLQQLRPQNSLLRLLTVKERERARAAFLARGSGSTVSEAECRRAQHSWFCKRFPEAPSCSVSISHVGPIADSSPASSSSKSQDKTLLPTEQESRFVDWPTFLQENVLYILAARPNSAAIHLKPPG

SEQ ID NO: 765840 - protein, 400 aa, Homo sapiens; identical to SEQ ID NO: 765839

SEQ ID NO: 765841 - protein, 400 aa, Homo sapiens; identical to SEQ ID NO: 765839

SEQ ID NO: 765842 - protein, 400 aa, Homo sapiens; identical to SEQ ID NO: 765839

SEQ ID NO: 765843 - protein, 400 aa, Homo sapiens; identical to SEQ ID NO: 765839

SEQ ID NO: 765844 - protein, 400 aa, Homo sapiens; identical to SEQ ID NO: 765839

SEQ ID NO: 765845 - protein, 400 aa, Homo sapiens; identical to SEQ ID NO: 765839

SEQ ID NO: 765846 - protein, 370 aa, Homo sapiens
MGVLMSKRQTVEQVQKVSLAVSAFKDGLRDRPSIRRTGELPGSRRGTVEGSVQEVQEEKEAEAGTSVVQEESSAGRAAWERLRDGRGVEPEEFDRTSRFTPPAFIRPTRKLDDDKPPEICLEPREPVVNDEMCDVCEVWTAESLFPCRVCTRVFHDGCLRRMGYIQGDSAAEVTEMAHTETGWSCHYCDNINLLLTEEEMYSLTETFQRCKVIPDCSLTLEDFLRYRHQAAKRGDRDRALSEEQEEQAARQFAALDPEHRGHIEWPDFLSHESLLLLQQLRPQNSLLRLLTVKERERARAAFLARGSGSTVSEAECRRAQHSWFCKRFPEAPSCSVSISHVGPIADSSPASSSSKSQDKTLLPTEQESRR

SEQ ID NO: 765847 - protein, 400 aa, Homo sapiens; identical to SEQ ID NO: 765839

SEQ ID NO: 765848 - protein, 421 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765849 - protein, 481 aa, Homo sapiens
SPGARHMQILGWPPGAAGLFVFLSHPGRGQRPAERMLWGSSRPGGERRSSLWPTCTKDRKMSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765850 - protein, 261 aa, Homo sapiens
MVAEAGLRTCTKDRKMSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLEGILVPSVCCLIPETGALKSGAWGPY

SEQ ID NO: 765851 - protein, 421 aa, Homo sapiens; identical to SEQ ID NO: 765848

SEQ ID NO: 765852 - protein, 421 aa, Homo sapiens; identical to SEQ ID NO: 765848

SEQ ID NO: 765853 - protein, 421 aa, Homo sapiens; identical to SEQ ID NO: 765848

SEQ ID NO: 765854 - protein, 421 aa, Homo sapiens; identical to SEQ ID NO: 765848

SEQ ID NO: 765855 - protein, 452 aa, Homo sapiens
MSPKRIAKRRSPPADAIPKSKKVKDTRAAASRRVPGARSCQGACGPSPPDQKTRPVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765856 - protein, 438 aa, Homo sapiens
MSPKRIAKRRSPPADAIPKSKKVKDTRAAASRRVPGARSCQVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765857 - protein, 421 aa, Homo sapiens; identical to SEQ ID NO: 765848

SEQ ID NO: 765858 - protein, 449 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRHCLFHTSQRLGWGKEVWRQGLSHLRVSKDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765859 - protein, 369 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765860 - protein, 421 aa, Homo sapiens; identical to SEQ ID NO: 765848

SEQ ID NO: 765861 - protein, 437 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLGCCEVKRVNEKKYQADERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765862 - protein, 421 aa, Homo sapiens; identical to SEQ ID NO: 765848

SEQ ID NO: 765863 - protein, 293 aa, Homo sapiens
MSPKRIAKRRSPPADAIPKSKKVKDTRAAASRRVPGARSCQVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLVERLLAPSVYAKSGKPGHYPEPRGTTLHQRQEDASNTRDGTSTQQPPRASPPRPPP

SEQ ID NO: 765864 - protein, 442 aa, Homo sapiens
RPVSLANYALEPRRRTLLDRKMSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765865 - protein, 512 aa, Homo sapiens
SPGARHMQILGWPPGAAGLFVFLSHPGRGQRPAERMLWGSSRPGGERRSSLWPTCTKDRKMSPKRIAKRRSPPADAIPKSKKVKDTRAAASRRVPGARSCQGACGPSPPDQKTRPVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765866 - protein, 351 aa, Homo sapiens
NFRLGTRPGWWLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765867 - protein, 66 aa, Homo sapiens
ILPCAQLVVGAHAPRRKPRPSLVTAYPTEAPQATEGDSSSLENRVVLSVSSGGQHTVLLVKDKEQS

SEQ ID NO: 765868 - protein, 436 aa, Homo sapiens
MVAEAGLRTCTKDRKMSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 765869 - protein, 156 aa, Homo sapiens [sequence omitted]

SEQ ID NO: 765870 - protein, 161 aa, Homo sapiens
TKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNV

SEQ ID NO: 765871 - protein, 141 aa, Homo sapiens
RARHMEPFMYQMVTATAGFVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRSF

SEQ ID NO: 765872 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 765873 - protein, 277 aa, Homo sapiens; identical to SEQ ID NO: 765872

SEQ ID NO: 765874 - protein, 182 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 765875 - protein, 277 aa, Homo sapiens; identical to SEQ ID NO: 765872

SEQ ID NO: 765876 - protein, 277 aa, Homo sapiens; identical to SEQ ID NO: 765872

SEQ ID NO: 765877 - protein, 277 aa, Homo sapiens; identical to SEQ ID NO: 765872

SEQ ID NO: 765878 - protein, 222 aa, Homo sapiens
NTISRSSPKFIGHSPQPLGYDRSSRSSYVDEDCDSLALCDPLQRTNCEVDSLPESCFDSGLSTLRDPNEYDSEVEYKHQRGFQRSHGVQESFGGDASDTDVPDIRDEETFGLEDVASVLDWKPQGSVSEGSIVSSSRKPISALSPQTDLVDDNAKSFSSQKAYKIVLAGDAAVGKSSFLMRLCKNEFRENISATLGVDFQMKTLIVDGERTVLQLWDTAGQE

SEQ ID NO: 765879 - protein, 70 aa, Homo sapiens
FGTEGDLPPPETEEIPLHAERAHQQIQAACETFDVRSQQHIQIPKLYTSNVTWGLHHFRLVQDSQPLDLS

SEQ ID NO: 765880 - protein, 71 aa, Homo sapiens
FILRSLWATPYLDEGFLALGQRNAEVNWPEAGADGCPMQMKVWPVLGHGHSWALSLSETWWKEEGGRDSGL

SEQ ID NO: 765881 - protein, 102 aa, Homo sapiens
SPGATADWGLLDYKTEKWALLAKKGYQERDLEPQISITTKLKGVSVTQIKELGNRLWDVADFVKPPQGENVFFLVTNFLVTPAQDQGRCPEIQGLAMLPRLE

SEQ ID NO: 765882 - protein, 179 aa, Homo sapiens
SLIYGVTSPQRGHSQHSEASQGPLSLDKPLQLPPIFLEGEKGESSVQNEQEGEPSLQSPSLELQSPAWPRHAGVAQEPLKVSSSYLSDTQSSESHVSSVQHPRPEEGSHASLSSGYAGDKEGSDISLVGSHRRVRLNRRLNTQAASNQTSQLGSIDPPSSLKSRLTGPAHSTKQTGGKE

SEQ ID NO: 765883 - protein, 67 aa, Homo sapiens
THRRYPKTTIHSTLFTQCMSVPSTVPGARDRAGLNVIRDTIHIEFLEAPLTEYSVQPADLAVYWQMQ

SEQ ID NO: 765884 - protein, 106 aa, Homo sapiens
ILGEMTSSGEGTELFQKPVEMWEECDAREIINLLALKMERIWEHPQLAARKRAEASALQLQEPELCQWCELPGGSPASDETAAQPTPRFLPRDALSRESSKVIPDF

SEQ ID NO: 765885 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 765886 - protein, 79 aa, Homo sapiens
ITHSHSGCGEQLSEGPGILAQRAVNEEGAVGRRQHVQRGEGGGCVMVDACENGQGMWGWMSQEGMRLRGPGLGRGGCGA

SEQ ID NO: 765887 - protein, 912 aa, Homo sapiens; identical to SEQ ID NO: 765885

SEQ ID NO: 765888 - protein, 662 aa, Homo sapiens
GTVVDPGLLGVRDVGPKKCGQEWGQFRGQTRLGWAGVCSYRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 765889 - protein, 865 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 765890 - protein, 929 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 765891 - protein, 876 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 765892 - protein, 658 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 765893 - protein, 828 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 765894 - protein, 632 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 765895 - protein, 482 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLLPPPAHALTGPAQSSTH

SEQ ID NO: 765896 - protein, 446 aa, Homo sapiens
MASNSSSCPTPGGGHLNGYPVPPYAFFFPPMLGGLSPPGALTTLQHQLPVSGYSTPSPANAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 765897 - protein, 107 aa, Homo sapiens
SVTPSMQDVSNTTTAQKRKCSQTQCPRKVIKMESEEGKEARLARSSPEQPRPSTSWSEAEHFILCTSALPVRMRCSTASRRTSRLAISSSSRWYRALTASSISALEG

SEQ ID NO: 765898 - protein, 688 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSSSPQSEVLYWKVHGAHGDRRATVLASPLLASPLLASPLLASPVSAESTRSLQPALWHIPPPSLASPPAR

SEQ ID NO: 765899 - protein, 470 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLRNALW

SEQ ID NO: 765900 - protein, 281 aa, Homo sapiens
DFQRIPRVDLVLDLVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 765901 - protein, 339 aa, Homo sapiens
SAGLRSPDVGWGTSPPNGSLQKATASKSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 765902 - protein, 292 aa, Homo sapiens
MVSSSPRGPPAPTPELSVTLGPHPALLSCPAQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 765903 - protein, 204 aa, Homo sapiens [sequence omitted]

SEQ ID NO: 765904 - protein, 566 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARRQENLNVAIETQSSSS

SEQ ID NO: 765905 - protein, 645 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPHPRQPTPRQPTPRQSSLC

SEQ ID NO: 765906 - protein, 658 aa, Homo sapiens; identical to SEQ ID NO: 765892

SEQ ID NO: 765907 - protein, 645 aa, Homo sapiens; identical to SEQ ID NO: 765905

SEQ ID NO: 765908 - protein, 680 aa, Homo sapiens
ALQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 765909 - protein, 882 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 765910 - protein, 470 aa, Homo sapiens; identical to SEQ ID NO: 765899

SEQ ID NO: 765911 - protein, 882 aa, Homo sapiens; identical to SEQ ID NO: 765909

SEQ ID NO: 765912 - protein, 519 aa, Homo sapiens
TLSLWGTVVDACSPTYFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 765913 - protein, 258 aa, Homo sapiens
MEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGEGRAQTLGAVVPPGDSVRGSMEASQVQVPLEASPITFPPPCAPERPPISPVPGARQAGL

SEQ ID NO: 765914 - protein, 929 aa, Homo sapiens; identical to SEQ ID NO: 765890

SEQ ID NO: 765915 - protein, 680 aa, Homo sapiens; identical to SEQ ID NO: 765908

SEQ ID NO: 765916 - protein, 169 aa, Homo sapiens
EKRELLLAPGDPYLGHHPIPQHTHSYSVTWSPIRAFPGVLATFPFLVLFYGGARGGLVLNIAVTSLPLLRAKHPSVGPGNCCAACWGGAECGPREGSTKHPLPLSPAGPSGCKYVRCQKRSRRVPVGALLPNESRDVRKRMIEVPRGVAERGIKNCNLKIKALTCSPKD

SEQ ID NO: 765917 - protein, 548 aa, Homo sapiens
MNEGAPGDSDLETEARVPWSIMGHCLRTGQARMSATPTPAGEGARSSSTCSSLSRLFWSQLEHINWDGATAKNFINLREFFSFLLPALRKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765918 - protein, 556 aa, Homo sapiens
MNEGAPGDSDLETEARVPWSIMGHCLRTGQARMSATPTPAGEGARRDELFGILQILHQCILSSGDAFVLTGVCCSWRQNGKPPYSQKEDKEVQTGYMNAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765919 - protein, 386 aa, Homo sapiens
MSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765920 - protein, 579 aa, Homo sapiens
WYHRVALKTEDRGSLGARISSDLYIGKKHGVSSGSPRPRRQRARQQRRGRGRRLQGDPAEPGIRPQERAACPGAQTELFQHQQRYLSNEEDTYMAGMVQSASLHSLAHELVPGPEGPTLEAAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765921 - protein, 534 aa, Homo sapiens
MTQALRSSWPRSPWFIHIPRKLCSSYCKQTPGGILRSKDLGKVITSFFLDHLLQLMQPKTAISSFTGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765922 - protein, 551 aa, Homo sapiens
WYHRVALKTEEEGVSELASPAISTLGKNMESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765923 - protein, 468 aa, Homo sapiens
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 765924 - protein, 318 aa, Homo sapiens
WYHRVALKTEEEGVSELASPAISTLGKNMESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELGNGMHASPGMLYSCPLK

SEQ ID NO: 765925 - protein, 377 aa, Homo sapiens
WYHRVALKTEEEGVSELASPAISTLGKNMESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAIGRGCTGSIRI

SEQ ID NO: 765926 - protein, 363 aa, Homo sapiens [sequence omitted]

SEQ ID NO: 765927 - protein, 363 aa, Homo sapiens [sequence omitted]

SEQ ID NO: 765928 - protein, 363 aa, Homo sapiens [sequence omitted]

SEQ ID NO: 765929 - protein, 197 aa, Homo sapiens
MSATGDRHPTQGDQEAPVSQEGAQAEAAGAGNQEGGDSGPDSSDVVPAAEVVGVAGPVEGLGEEEGEQAAGLAAVPRGGSAEEDSDIGPATEEEEEEEEGNEAANFDLAVVARRYPAAGIHFVLLDMVHSLLRRLYHNDHIQIANRHLSRLMVGPHAAVPNLWDNPPLLLLSQRLGAGAAAPEGEGLGLIQEAASVQ

SEQ ID NO: 765930 - protein, 872 aa, Homo sapiens
MNLIVKLRRSFRTLIVLLATFCLVSIVISAYFLYSGYKQEMTLIETTAEAECTDIKILPYRSMELKTVKPIDTSKTDPTVLLFVESQYSQLGQDIIAILESSRFQYHMVIAPGKGDIPPLTDNGKGKYTLVIYENILKYVSMDSWNRELLEKYCVEYSVSIIGFHKANENSLPSTQLKGFPLNLFNNLALKDCFVNPQSPLLHITKAPKVEKGPLPGEDWTIFQYNHSTYQPVLLTELQTEKSLSSLSSKTLFATVIQDLGLHDGIQRVLFGNNLNFWLHKLIFIDAISFLSGKRLTLSLDRYILVDIDDIFVGKEGTRMNVKDVKALLETQNLLRTQVANFTFNLGFSGKFYHTGTEEEDEGDDLLLRSVDEFWWFPHMWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQHQRSHEDPAALRFNFYEVISTGHWAPSDLKTLQRRCLVPGWYAVHIERWLTYFATSQLLIIDGQQLRSDPATVMDEVQKFLGVTPRYNYSEALTFDPQKGFWCQLLEGGKTKCLGKSKGRKYPPMDPESRTFLSNYYRDHNVELSKLLHRLGQPLPSWLRQELQKVR

SEQ ID NO: 765931 - protein, 71 aa, Homo sapiens
KVCSFTPEPARPRTNQKEETPNTSEHQKEQTPDTPPLRTVTLTGRVRSFILEVSETKNPPIPDTLISHSQK

SEQ ID NO: 765932 - protein, 71 aa, Homo sapiens; identical to SEQ ID NO: 765931

SEQ ID NO: 765933 - protein, 3434 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGCANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 765934 - protein, 3472 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPWLPDSTALPTVWTCPQAPLLELRSCKCRPKHQMGALSPITLQQREQVAPLAWSHRVGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGCANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEAWPTQEPSLCPPSQQTQLQPGPSSHQLLTAPPSAMKAPCPQLPCPPASHPLCLLWLLAHPLSHHLGWPRVPQPQHSAQSLAWSHLMTRSCTSSCGPGWAPTWDAHSVPNAGPTLSLPWAASDYDWLRGGHHQAPALHPELPSPLRVLGPQKPCCSLTCDQVQCGEKYEGGSSPGFSSVRDPCPAPAP

SEQ ID NO: 765935 - protein, 3394 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPWLPDSTALPTVWTCPQAPLLELRSCKCRPKHQMGALSPITLQQREQVAPLAWSHRVGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGCANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 765936 - protein, 2882 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPWLPDSTALPTVWTCPQAPLLELRSCKCRPKHQMGALSPITLQQREQVAPLAWSHRVGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGCANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTLWRDPQSP

SEQ ID NO: 765937 - protein, 297 aa, Homo sapiens
SIQPSTGAITVRSAEGLDFEVSPRLRLVLQAESGGAFAFTVLTLTLQDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSGGWGPGHGQAALLWFLGI

SEQ ID NO: 765938 - protein, 690 aa, Homo sapiens
SIQPSTGAITVRSAEGLDFEVSPRLRLVLQAESGGAFAFTVLTLTLQDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEAWPTQEPSLCPPSQQTQLQPGPSSHQLLTAPPSAMKAPCPQLPCPPASHPLCLLWLLAHPLSHHLGWPRVPQPQHSAQSLAWSHLMTRSCTSSCGPGWAPTWDAHSVPNAGPTLSLPWAASDYDWLRGGHHQAPALHPELPSPLRVLGPQKPCCSLTCDQVQCGEKYEGGSSPGFSSVRDPCPAPAP

SEQ ID NO: 765939 - protein, 3401 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPWLPDSTALPTVWTCPQAPLLELRSCKCRPKHQMGALSPITLQQREQVAPLAWSHRVGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGCANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPTLHPELPSPLRVLGPQKPCCSLTCDQVQCGEKYEGGSSPGFSSVRDPCPAPAP

SEQ ID NO: 765940 - protein, 1269 aa, Homo sapiens
RGEGRGGEGARGRGSGARILGGAAVQEAAPGRQRTDRSTAKGARTDGGCPEGIAGLGDSDSDDARPQAPRERALPGGLTAAGRRPSTGRGSPRRAEVREPELEPGPQWDLTQSLRSSWAQSLAWSWSPRHSWTTLVMQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPWLPDSTALPTVWTCPQAPLLELRSCKCRPKHQMGALSPITLQQREQVAPLAWSHRVGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTVGSSDKRDCVHSG

SEQ ID NO: 765941 - protein, 234 aa, Homo sapiens
GSLTYWVPERLRQGFCGVGRAAQALVCASAKEGTAFRMEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGRRHPERPWLLGQCCILLSVSSAFLVERCSRGSVSDRWAARRRCDSLGNKGELPRTNVAVESRSRRGYYCPACGRETLGDAEQQTFGASF

SEQ ID NO: 765942 - protein, 77 aa, Homo sapiens
AWISLLLITTTAATPPSHQSQPGVQQPPETTGLSGQCEPHCRSSPCGTSPEALLFRVPIYLGIEELGRNSGLTTPQG

SEQ ID NO: 765943 - protein, 407 aa, Homo sapiens
LLGRCGLAFRPLATEPRGSSPVQLVSSTMSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 765944 - protein, 407 aa, Homo sapiens; identical to SEQ ID NO: 765943

SEQ ID NO: 765945 - protein, 384 aa, Homo sapiens
LLGRCGLAFRPLATEPRGSSPVQLVSSTMSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQSLFSNLATIQGGLTG

SEQ ID NO: 765946 - protein, 261 aa, Homo sapiens
LLGRCGLAFRPLATEPRGSSPVQLVSSTMSVRTLPLLFLNLGGEMLYILDQRLRAQNIPGDKARKDEWTEVDRKRVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRRECFWKHMQETVHSAQCCLPGVGNYMEDRRRRLTFHHVYPFENFEFCTWAK

SEQ ID NO: 765947 - protein, 278 aa, Homo sapiens
LLGRCGLAFRPLATEPRGSSPVQLVSSTMSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNM

SEQ ID NO: 765948 - protein, 278 aa, Homo sapiens; identical to SEQ ID NO: 765947

SEQ ID NO: 765949 - protein, 407 aa, Homo sapiens; identical to SEQ ID NO: 765943

SEQ ID NO: 765950 - protein, 284 aa, Homo sapiens
MAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEQAALTRPEELSYEVINIQATQDQQRSEELARIMGEFEITEQPRLSTSKGDDLLAMMDEL

SEQ ID NO: 765951 - protein, 355 aa, Homo sapiens
LLGRCGLAFRPLATEPRGSSPVQLVSSTMSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQESIAPNPLAKEELNFLARLMGGMEIKKPSGPEPGFRLNLFTTDEEEEYVLNLFR

SEQ ID NO: 765952 - protein, 324 aa, Homo sapiens
LLGRCGLAFRPLATEPRGSSPVQLVSSTMSVRTLPLLFLNLGGEMLYILDQRLRAQNIPGDKARKVLNDIISTMFNRKFMEELFKPQELYSKKALRTVYERLAHASIMKLNQASMDKLYDLMTMAFKYQVLLCPRPKDVLLVTFNHLDTIKGFIRDSPTILQQVDETLRQLTEIYGGLSAGEFQLIRQTLLIFFQDLHIRVSMFLKDKVQNNNGRFVLPVSGPVPWGTEVPGLIRMFNNKGEEVKRIEFKHGGNYVPAPKEGSFELYGDRVLKLGTNMYSVNQPVETHVSGSSKNLASWTQVSFCLPCLPSQLLSRYGSLHKER

SEQ ID NO: 765953 - protein, 160 aa, Homo sapiens
GPLLWDTLPSVFSSMRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 765954 - protein, 158 aa, Homo sapiens
RAAGIRHEVFSSMRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 765955 - protein, 160 aa, Homo sapiens; identical to SEQ ID NO: 765953

SEQ ID NO: 765956 - protein, 158 aa, Homo sapiens; identical to SEQ ID NO: 765954

SEQ ID NO: 765957 - protein, 311 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765958 - protein, 432 aa, Homo sapiens
MLALPLVLTTDLAGLAPLLCVGRPHPVTGALFSRIIQQLVNGIITPATIPSLGPWGVLHSNPMDYAWGANGLDAIITQVQRGHGPECLLGEGWAAHPWELPHCLDPRSPTKVKGDAGTASTLWRAQGAAPAFLLPFLSLGNFGGSPVFTRNVVAKPRGGLAHSHMVQEATRSLFPRGRALTCFQVPPVSALLRSPWSILSLAGPDPHSSPPAGARPPHSAVRALRSAAPPPIPLSGTQERGPPPIPPFHRQGTQERGGRVGSTVISDPGLGSKGPRAQDKRGLGAFAGPAASRFRAPGRAPEELPALSPLVFQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765959 - protein, 153 aa, Homo sapiens
KPGLVTGSWESSPGNIGRTPTGRISNARQLPRLPKKPHGTEHGHEPPWPHWGELLLLVVIVLLQLAQQRERHKQLVSPRRPSGKHGAFPTHPQPAPHGTHRLGAPAAPRLAGQRCRSRLFQGRTRARPTGPLAWEGVGHMVPSGASPASPSSV

SEQ ID NO: 765960 - protein, 311 aa, Homo sapiens; identical to SEQ ID NO: 765957

SEQ ID NO: 765961 - protein, 365 aa, Homo sapiens
VRERARARRPAREQQTAGGGCRAGGGRRGVGGGGHGRGVAASRTVLLPLLLRGDRPAPAGLYLSKMRVWFYRGASGRDQEHRKWFCPLHSSHRPEPATVGAPPADCTGLSPEVTPPSSPQHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765962 - protein, 284 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765963 - protein, 278 aa, Homo sapiens
LAVAGEAGCLTARQPGIISVQDASLVLSRSFRKRPGAQKMVLPPPQLPQTRAGHRWSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765964 - protein, 349 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGVSSPESVQSNRIIIQAAGIDHPSSWCRACEEFHATSESAYEELTAMDRAPTVIGMTNQCHGRLASDRRLCGTHIPRHRGQRAIISSRNNHKGRFTRDQCPRCGSRSTVRHPGVRSCPRRSNRYKSHALGERVRQLPCNHLFHDGCIVPWLEQHDSCPVCRKSLTGQNTATNPPGLTGVSFSSSSSSSSSSSPSNENATSNS

SEQ ID NO: 765965 - protein, 216 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGVRGPRGWPRGPHALRSEVLALRIQHGFHGNVASSIGSLERPPGQALQPPVTPHTALRRQKYAGSGCVG

SEQ ID NO: 765966 - protein, 311 aa, Homo sapiens; identical to SEQ ID NO: 765957

SEQ ID NO: 765967 - protein, 334 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATPLWGVPSLPVLCLTSPSKRSAVERFL

SEQ ID NO: 765968 - protein, 311 aa, Homo sapiens; identical to SEQ ID NO: 765957

SEQ ID NO: 765969 - protein, 334 aa, Homo sapiens; identical to SEQ ID NO: 765967

SEQ ID NO: 765970 - protein, 337 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQVLQPRVSEPRAGPPRSSRQLSPLVFQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765971 - protein, 286 aa, Homo sapiens
CWFAREYDIVDPRAPETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPCLHSTPVCDIRLREAQRSGLTIDSRKLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 765972 - protein, 135 aa, Homo sapiens
MPRLLKGKASGRPRTISTEQQWQKYRRHRPPPARPATRTPQATREPTSAVGKARGLSHPPSASATRHPQTGCPGGATLGWSALQVPPVPGQDPGPAHRPPGLGRRGPHGPLWGVPSLPVLCLTSPSKRSAVERFL

SEQ ID NO: 765973 - protein, 132 aa, Homo sapiens
MDSCYDPRKLLTATSVDEHLAAALNTCCESCQNQNGVTNVKKALTKSWWGRPRREDTYACMPDTRKDYKNHSPAQRPSHPYTKNISARTTAQQLPVQPQTGMTFVIDVCSQGELSQNHCDPARFSFKDLCLP

SEQ ID NO: 765974 - protein, 163 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGVSQGPAQSQVEVSLGPGTDYRTLGKTLHCHVTQFPHLPDGCCCENYEMK

SEQ ID NO: 765975 - protein, 122 aa, Homo sapiens
MPRSSRSPGDPGALLEDVAHNPRPRRIAQRGRNTSRMAEDTSPNMNDNILLPVRNNDQALGLTQCMLGCVYASCCARSSWRRQAFCSSVLSVCPRALPSPRWRYPWALALIIGHWARHCTAT

SEQ ID NO: 765976 - protein, 227 aa, Homo sapiens
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIEGPALTLSTRQSPITMRRPTPTG

SEQ ID NO: 765977 - protein, 177 aa, Homo sapiens
FVLKACILGYTLRTLFLPFPPRGKSPDLGQRVPRAYARRHSPLPTPKSAKKRIPLSGVARGRHPSAPSSYAGSACPRTNHTGLILSAPAYSRALQPETQQRGLGDPAHCGPLGACPWMSTLAPDELTVKTKDGVVEITGKHEEAAGTSMATSPGASRGNTCPPGVDPNQVFLLPCPE

SEQ ID NO: 765978 - protein, 239 aa, Homo sapiens
GAGTKPKPHWPREPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRNRYLK

SEQ ID NO: 765979 - protein, 365 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQALKLQLDNQYAVLENQKSSHSQYN

SEQ ID NO: 765980 - protein, 156 aa, Homo sapiens
MQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQALKLQLDNQYAVLENQKSSHSQYN

SEQ ID NO: 765981 - protein, 320 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRNRYLK

SEQ ID NO: 765982 - protein, 316 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRK

SEQ ID NO: 765983 - protein, 365 aa, Homo sapiens; identical to SEQ ID NO: 765979

SEQ ID NO: 765984 - protein, 73 aa, Homo sapiens
GYVPEDGLTAQQLFASADGLTYNDFLILSRILLRGGFFLNSRTNIFKNPSEEEIFTDYISFPLGIKKWRRALK

SEQ ID NO: 765985 - protein, 317 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKY

SEQ ID NO: 765986 - protein, 320 aa, Homo sapiens; identical to SEQ ID NO: 765981

SEQ ID NO: 765987 - protein, 320 aa, Homo sapiens; identical to SEQ ID NO: 765981

SEQ ID NO: 765988 - protein, 320 aa, Homo sapiens; identical to SEQ ID NO: 765981

SEQ ID NO: 765989 - protein, 320 aa, Homo sapiens; identical to SEQ ID NO: 765981

SEQ ID NO: 765990 - protein, 320 aa, Homo sapiens; identical to SEQ ID NO: 765981

SEQ ID NO: 765991 - protein, 333 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRNRLLKMNATWLPGVSVYL

SEQ ID NO: 765992 - protein, 295 aa, Homo sapiens
HELARACLFPSGCGESGILLRRRSSSGSPGSLGRQRRRASPRADRTTARQHAGGAARLAAHASATPRGWGVAAPGSVSAEPASTPSSEPRGPRPPPAPPIRVEEAEAMAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVQNPRPRDCVIGSWASYHTKNTQGPRISCSIPS

SEQ ID NO: 765993 - protein, 412 aa, Homo sapiens
KLRLVRGWFSDEGATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 765994 - protein, 187 aa, Homo sapiens
MTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 765995 - protein, 129 aa, Homo sapiens
LYRIFCALGRRCVWLRRCWGKTEWVLESEALVARPQWRGGGVRPWTHAQDRKAGAEHYPKKDPTEDLWRRRVQQEVTPRRPKAQPAPTCQKHSRAFLHALLHSDNTAALHHLTVHNIAYQVSQCPGQGG

SEQ ID NO: 765996 - protein, 410 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 765997 - protein, 387 aa, Homo sapiens [sequence omitted]

SEQ ID NO: 765998 - protein, 494 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYVVDREARALPVGSGFLGTPYPAWGGGIWGNGHRSDLRRLGRHGCPLGAILREYGPVWGSVRVGRGPGKPLRFSAPSRHGCNPSYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 765999 - protein, 538 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYVVDREARALPVGSGFLGTPYPAWGGGIWGNGHRSDLRRLGRHGCPLGAILREYGPVWGSVRVGRGPGKPLRFSAPSRHGCNPSYATDLVVCVALGCDMFDCVFPTRTAAVRLWQKEVRAGDGWGTREARLGVGGGENEALGDAPFPALPLPQRFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 766000 - protein, 282 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGALALPWCPLGTCS

SEQ ID NO: 766001 - protein, 362 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTASDNTAALHHLTVHNIAYQLQLMSAVRTSIVEKRFPDFVRDFMGAMYGDPTLCPTWATDALASVGITLG

SEQ ID NO: 766002 - protein, 438 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEGPQSESLKSRTLAGYHSSHLNPSTLGGQEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 766003 - protein, 395 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 766004 - protein, 492 aa, Homo sapiens
HVVPTVKMAGAATQASLESAPRIMRLVAECSRSRARAGELWLPHGTVATPVFMPVGTQATMKGITTEQLDALGCRICLGNTYHLGLRPVGGLCPRGEAARRRGVGSHGASSRPGHSSQSQSTSCIERPQMTRPCTGRERAAGTKAGQICLPRRAPRDAVTPNLTLSSINPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 766005 - protein, 402 aa, Homo sapiens
QATSCDSAPCIHAVGDPHCNRVRVCRAGAETVAVRLLHCSTPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 766006 - protein, 195 aa, Homo sapiens
KLKSSQKDKVRQFMIFTQSSEKTADSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGALALPWCPLGTCS

SEQ ID NO: 766007 - protein, 113 aa, Homo sapiens
HVVPTVKMAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTVS

SEQ ID NO: 766008 - protein, 91 aa, Homo sapiens
LAVLSCPLPLYRHSRAFLHALLHSDNTAALHHLTVHNIAYQLQLMSAVRTSIVEKRFPDFVRDFMGAMYGDPTLCPTWATDALASVGITLG

SEQ ID NO: 766009 - protein, 527 aa, Homo sapiens
MSLCGARANAKMMAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 766010 - protein, 128 aa, Homo sapiens
VCAGHHPLSPPTLLSRSSRRRGQESARFRPYPARLPGLLFFGPGTLTFSRGGSLRLGVRALPTSFIPPCTSFPSLLPRLSFSSLSCCRLLSSLQPPSLAYSAQESLEPPPPLPNQVNLTRSRGRCRKA

SEQ ID NO: 766011 - protein, 128 aa, Homo sapiens; identical to SEQ ID NO: 766010

SEQ ID NO: 766012 - protein, 527 aa, Homo sapiens; identical to SEQ ID NO: 766009

SEQ ID NO: 766013 - protein, 124 aa, Homo sapiens
VSDAGSALSGFARGAAAAAAAAAAAAMLNPGQQQPYFPSPAPGQAPGPAAAAPAQVQAAAAATVKAHHHQHSHHPQQQLDIEPDRPIGYGAFGVVWLRICSTEKFLHYQPRLTATAGFFGGSAL

SEQ ID NO: 766014 - protein, 144 aa, Homo sapiens
QAVNVSFERSYVDSHFICSVDVLVSNLFQSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 766015 - protein, 100 aa, Homo sapiens
TFPAVVAMVRDAFLLEKGRGKSKGDFVLQLEYQLSHSGIEHQVGFQGSHFQTSSPVWHFCTRPGPERNALLRKKRLSIGGSKAVVTIGFEQEPVLGWLRI

SEQ ID NO: 766016 - protein, 119 aa, Homo sapiens
GKDPFWRAVGVAQKAAAVVACGAASPYRNRADVSVSDHSQSREGVQVILRRVRLSRVQDADLLDFCKPLEATYSFLMTALHLCWKNTHCDNCCLCLVCPGALPTSMFAEKPTLFLLAAM

SEQ ID NO: 766017 - protein, 247 aa, Homo sapiens
GKDPFWRAVGVAQKAAAVVACGAASPYRNRADVSVSDHSQSRGPGGLSLSGGTVCDMGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 766018 - protein, 224 aa, Homo sapiens
WEGRPLLLAQRERKNWGDPGPGGLSLSGGTVCDMGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 766019 - protein, 250 aa, Homo sapiens
GKDPFWRAVGVAQKAAAVVACGAASPYRNRADVSVSDHSQSRGPGGLSLSGGTVCDMGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDADSLTYTFTLLLSS

SEQ ID NO: 766020 - protein, 159 aa, Homo sapiens
GKDPFWRAVGVAQKAAAVVACGAASPYRNRADVSVSDHSQSRGPGGLSLSGGTVCDMGKKTKRTADSSSSEDEEEYVVEKVLDRRVVKGQVEYLLKWKGFSEEHNTWEPEKNLDCPELISEFMKKYKKMKEGENDQCPLRQSSPRHRQGRAKRFVREIK

SEQ ID NO: 766021 - protein, 47 aa, Homo sapiens
MGKKTKRTADSSSSEDEEEYVVEKVLDRRVVKVNLQEDRSFLPDHYG

SEQ ID NO: 766022 - protein, 1026 aa, Homo sapiens
MPRISIRVDKNRTKIGQSSSGGDMGLLICRKWQPIQVAQCMPPSSSGHVNCSDLIFKTKNLVCGQRTCQYLVLRLVLRNLGHVAAVVIGNIYDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHQVSNAKNLFFLCLVLFQDIFLSLSVINIKRSPFLQSYSTALPSRGYQGQLSSPLIAGLGRWPSSLDQMPGKSAYMGAPILNLERTMMFSSSNNNLVFFPPVLKLYCLSDKYNFYLKLEHTIFMLSKLNLHLDFLLSRSQRRSYIGSRFKFNSVFYFFSYVFYQLLLPFQIRIFFRRLFYLSTDCIFSFLIRSPGEMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLGVVSEEGQVMGRQDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLWCFLQLKVRWSLTVPQPYCILLCAFYFVSLMKDWFCPCNLGIYYSYSSFLFCSHPAVHFPYVQAKPQGIGEGFWDFLIEILLNLYFTPAFLRYSEGLEGSVFGPGSNCLYLKVQFSGHKILLCNVMRTPLDLKCGNGFSQFKGENPLCTHDPIILVEILELKNISVEIRTFVIRPPSMPVARQRGKVWSQCIAVSCYLYLLIIKIMFSKVDDTSLTPKNMF

SEQ ID NO: 766023 - protein, 991 aa, Homo sapiens
MPRISIRVDKNRTKIGQSSSGGDMGLLICRKWQPIQVAQCMPPSSSGHVNCSDLIFKTKNLVCGQRTCQYLVLRLVLRNLGHVAAVVIGNIYDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHQVSNAKNLFFLCLVLFQDIFLSLSVINIKRSPFLQSYSTALPSRGYQGQLSSPLIAGLGRWPSSLDQMPGKSAYMGAPILNLERTMMFSSSNNNLVFFPPVLKLYCLSDKYNFYLKLEHTIFMLSKLNLHLDFLLSRSQRRSYIGSRFKFNSVFYFFSYVFYQLLLPFQIRIFFRRLFYLSTDCIFSFLIRSPGEMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLGVVSEEGQVMGRQDEKSPGLACLRRLPTTSSLRLLEFLSPKQASVFCSQCYISKFFLNYWKQSLALLSLVWGHCWYQKSKSYSFDVGHEIINNFILVYDELTINSLSAYKLCFCSKKKYVWYNKCYKPIHISDLGAETDWLMLYSLLPWSKKLTLISAYMWKRPITLGELSQLAIEHKNIFQEINIAGGLEMLLLLREKTGELGLRTPDFHPWFEILGQSSGRVNLCLWKALTMLQIQLCYIIVGSITTYSSWTLYQSCSHLFQFLIPFGGMNMRLNCLYSLKRTCFPMTRDFLKRSLGAHLLIPEHLLCSSAVLFNTGERVISFFLRRSLALSPRLECSGAISAHCKLHLPGSRHSPASASRGAGTTGAGHHARLIFVFLVETGFHLVSQDGLNLLTS

SEQ ID NO: 766024 - protein, 1026 aa, Homo sapiens; identical to SEQ ID NO: 766022

SEQ ID NO: 766025 - protein, 995 aa, Homo sapiens
MPIQVAQCMPPSSSGHVNCSDLIFENQKPSMWTKNMTIFGTEIGSEKPGACGCCGYKVIFEDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHQVSNAKNLFFLCLVLFQDIFLSLSVINIKRSPFLQSYSTALPSRGYQGQLSSPLIAGLGRWPSSEDQMPGKSAYMGAPILNLERTMMFSSSNNNLVFFPPVLKLYCLSDKYNFYLKLEHTIFMLSKLNLHLDFTPQRSQRRSYIGSRFKFNSVFYFFSYVFYQLLLPFQIRIFFRRLFYLSTDCIFSFLIRSPGEMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLWCFLQLKVRWSLTVPQPYCILLCAFYFVSLMKDWFCPCNLGIYYSYSSFLFCSHPAVHFPYVQAKPQGIGEGFWDFLIEILLNLEFTPAFLRYSEGLEGSVFGPGSNCLYLKVQFCGHKILLCNVMRTPLDLKCGNGFSQFKGENPLCTHDPIILVEILELKNISVEIRTFVIRPPSMPVARQRGKVWSQCIAVSCYLYLLIIKIMFSKVDDTSLTPKNMF

SEQ ID NO: 766026 - protein, 1111 aa, Homo sapiens
MTDWNNEAFWFKSARKILLNGNVIGQELINHTSSGWEFYLYIPSLSEGIKGLDQCWIIDNCLYLICSVSKRRKGWSGNIYHKCSQGYQLEVDKNRTKIGQSSSGGDMGLLICRKGQPIQVAQCMPPSSSGHVNCSDLIFKTKNLVCGQRTCQYLVLRLVLRNLGHVAAVVIGNIEDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHLSPNAKNLFFLCLVLFQDIFLSLSVINIKRSPFLQSYSTALPSRGYQGQLSSPLIAGLEQMAFKLRSNAGKISLHGSTHFKPGENHDVFFFKYQSSFFSPSTKIVLSFRQYNFYLKLEHTIFMLSKLNLHLDFLLSRSQRRSYIGSRFKFNSVFYFFSYVFYQLLLPFQIRIFFRRLFYLSTDCIFSFLIRSPGYMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSCPLCALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLLVLLTIKSLDGPVTVPQPYCILLCAFYFVSLMKDWFCPCNLGIYYSSTLHFLFCSHPAVHFPYVQAKPQGIGEGFWDFLIEILLNLEFTPAFLRYSEGLEGSVFGPGSNCLYLKVQFSGHKILLCNVMRTPLDLKCGNGFSQFKGENPLCTHDPIILVEILELKNISVEIRTFVIRPPSMPVARQRGKVWSQCIAVSCYLYLLIIKIMFSKVDDTSLTPKNMF

SEQ ID NO: 766027 - protein, 1026 aa, Homo sapiens; identical to SEQ ID NO: 766022

SEQ ID NO: 766028 - protein, 917 aa, Homo sapiens
MARAPEEVIWVSLFAENDSLIQVAQCMPPSSSGHVNCSDLIFKTKNLVCGQRTCQYLVLRLVLRNLGHVAAVVIGNIEDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHQVSNAKNLFFLCLVLFQDIFLSLSVINIKRSPFLQSYSTALPSRGYQGQLSSPLIAGLEQMAFKLRSNAGKISLHGSTHFKPGENHDVFFFKEQSSFFSPSTKIVLSFRQYNFYLKLEHTIFMLSKLNLHLDFLLSRSQRRSYIGSRFKFNSVFYFFSYVFYQLLLPFQIRIFFRRLFYLSTDCIFSFLIRSPGEMADILPWMILGGSLRFQSDCLSSSCLDPNADIHLYYLFIFFRQSLALSPGWSAVAQSWLTVPSTSWVQAILLPQPLEYAGTTGVCHHAQLIFVFLVEMGFYHVCQDGLDFLTLGSAHLGLPKCWNYRHEPPCLATSIKFLWTKIKLSLFVCSHGALSVIQFFLNSSALFVALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLWCFLQLKVRWSLTVPQPYCILLCAFYFVSLMKDWFCPCNLGIYYSSTLHSCSVATQQSIFPMFRPNHRALGKVFGIFLLNFVESVVYPSFPKVTVRGWRDLCLARGAIVSTLRFSFEGIKYYFAMS

SEQ ID NO: 766029 - protein, 247 aa, Homo sapiens; identical to SEQ ID NO: 766017

SEQ ID NO: 766030 - protein, 879 aa, Homo sapiens
MVGSQRPVLISALSTKEIRCLLPAFVSVEVDVLALEELQPQTETCFMELSPLRRVNSYELSTLKHLKSQMLKIYFFLCLVLFQDIFLSLSVINIKRSPFLQSYSTALPSRGYQGQLSSPLIAGLGRWPSSYDQMPGKSAYMGAPILNLERTMMFSSSNNNLVFFPPVLKLYCLSDKYNFYLKLEHTIFMLSKLNLHLDFSSSVDPREEADIGSRFKFNSVFYFFSYVFYQLLLPFQIRIFFRRLFYLSTDCIFSFLIRSPGYMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLWCFLQLKVRWSLTVPQPYCILLCAFYFVSLMKDWFCPCNLGIYYFNSSFLFCSHPAVHFPYVQAKPQGIGEGFWDFLIEILLNLYFTPAFLRYSEGLEGSVFGPGSNCLYLKVQFSGHKILLCNVMRTPLDLKCGNGFSQFKGENPLCTHDPIILVEILELKNISVEIRTFVIRPPSMPVARQRGKVWSQCIAVSCYLYLLIIKIMFSKVDDTSLTPKNMF

SEQ ID NO: 766031 - protein, 872 aa, Homo sapiens
MWTKNMTIFGTEIGSEKPGACGCCGYEVIFEDIHKNLIFFYRNNPSIIYYLPSVNRLYSVFFVFGFIVLSAAKTTFVLFLPTCSWFYRNVGSQRPVLISALSTKEIRCLLPAFVSVEVDVLALEELQPQTETCFMELSPLRRVNSEELSTLKHLKSQMLKIYFFLCLVLFQDIFLSLSVINIKRSPFLQSYSTALPSRGYQGQLSSPLIAGLGRWPSSLDQMPGKSAYMGAPILNLERTMMFSSSNNNLVFFPPVLKLYCLSDKYNFYLKLEHTIFMLSKLNLHLDFSSSVDPREEADIGSRFKFNSVFYFFSYVFYQLLLPFQIRIFFRRLFYLSTDCIFSFLIRSPGEMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITGVLESLTTIHWGAILRRIFGYLYSLQLVDDCFLVYQLHLYLLFCSWKILYLLGFFVCLFVFPTYSKYKWSEVILVFLRGLPCVKVDFLLLIYSHYRQNSGEQCCHGQNPVLVHSGEHLDLWCFLQLKVRWSLTVPQPYCILLCAFYFVSLMKDWFCPCNLGIYYFLTLHSCSVATQQSIFPMFRPNHRALGKVFGIFLLNFVESVVYPSFPKVTVRGWRDLCLARGAIVSTLRFSFEGIKYYFAMS

SEQ ID NO: 766032 - protein, 820 aa, Homo sapiens
MLSTLKHQVSNAKNLFFLCLVLFQDIFLSLSVINIKRSPFLQSYSTALPSRGYQGQLSSPLIAGLEQMAFKLRSNAGKISLHGSTHFKPGENHDVFFFKYQSSFFSPSTKIVLSFRQYNFYLKLEHTIFMLSKLNLHLDFLLSRSQRRSYIGSRFKFNSVFYFFSYVFYQLLLPFQIRIFFRRLFYLSTDCIFSFLIRSPGEMADILPWMILGGSLKNSKVIVCLLLVLILMQTFTSIIYLFFLDRVSLCHQAGVQWHNLGLLYPPPPGFKRFSCLSLSSSWDYRCVPPCPANFCIFGRDGVLPCLPGWSRFPDLGSAHLGLPKCWNYRHEPPCLATSIKFLWTKIKLSLFVCSHGALSVIQFFLNSSALFVALSSVIPDFAKDLRGGFRGGSGDGKEDEKSPGLACLRRLPTTSSLRLLEFLSPKQASVFCSQCYISKFFLNYWKQSLALLSLVWGHCWYQKSKSYSFDVGHESSITELLESLTTIHWGAILRRIFGYLYSLQLVDDCFLVYQLHLYLLFCSWKILYLLGFFVCLFVFPTYSKKKWSEVILVFLRGLPCVKVDFLLLIYSHYRQNSGEQCCHGQNPVLVHSGEHLDLLVLLTIKSLDGPVTVPQPYCILLCAFYFVSLMKDWFCPCNLGIYYSYSSFLFCSHPAVHFPYVQAKPQGIGEGFWDFLIEILLNLYFTPAFLRYSEGLEGSVFGPGSNCLYLKVQFSGHKILLCNVMRTPLDLKCGNGFSQFKGENPLCTHDPIILVEILELKNISVEIRTFVIRPPSMPVARQRGKVWSQCIAVSCYLYLLIIKIMFSKVDDTSLTPKNMF

SEQ ID NO: 766033 - protein, 247 aa, Homo sapiens; identical to SEQ ID NO: 766017

SEQ ID NO: 766034 - protein, 998 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 766035 - protein, 978 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 766036 - protein, 537 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPEIKETDGSSQIKQEPDPTW

SEQ ID NO: 766037 - protein, 957 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 766038 - protein, 977 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 766039 - protein, 121 aa, Homo sapiens [sequence omitted]

SEQ ID NO: 766040 - protein, 71 aa, Homo sapiens
ELWPTFADQESTLALIREPLVCGNCQSADVKRVPDWVMVSPEVAPQLCHSVSTATSLILTSHGEVRFLQGK

SEQ ID NO: 766041 - protein, 494 aa, Homo sapiens [sequence omitted]

SEQ ID NO: 766042 - protein, 494 aa, Homo sapiens [sequence omitted]

SEQ ID NO: 766043 - protein, 494 aa, Homo sapiens [sequence omitted]

SEQ ID NO: 766044 - protein, 371 aa, Homo sapiens
MRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVSRGRSQEKSLRQSRSRSRSKAGSRSRSRSRSKSKDKRKSRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 766045 - protein, 371 aa, Homo sapiens; identical to SEQ ID NO: 766044

SEQ ID NO: 766046 - protein, 371 aa, Homo sapiens; identical to SEQ ID NO: 766044

SEQ ID NO: 766047 - protein, 464 aa, Homo sapiens [sequence omitted]

SEQ ID NO: 766048 - protein, 317 aa, Homo sapiens
MSRGEAGCKSAEGRPRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVSRGRSQEKSLRQSRSRSRSKAGSRSRSRSRSKSKDKRKSRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 766049 - protein, 341 aa, Homo sapiens
MRQAGEVTYADAHKGRKNEGVIEFVSYSDMKRALEKLDGTEVNGRKIRLVEDKPGSRRRRSYSRSRSHSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVSRGRSQEKSLRQSRSRSRSKAGSRSRSRSRSKSKDKRKSRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 766050 - protein, 442 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVSRGRSQEKSLRQSRSRSRSKAGSRSRSRSRSKSKDKRKSRKRSREESRSRSRSRSKSERSRKRGSKRDSKAGSSKKKKKEDTDRSQSRSPSRSVSKEREHAKFFCTCLVAVAQVIGVEHVTAVHF

SEQ ID NO: 766051 - protein, 366 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSTRARTRGRAGREAERRAAVAVAAAARVRGAESEAASETARRAAGPEQEPQQEQGQEEEQEEKQRGEPQSI

SEQ ID NO: 766052 - protein, 71 aa, Homo sapiens; identical to SEQ ID NO: 766040

SEQ ID NO: 766053 - protein, 208 aa, Homo sapiens
RVQKAVAQADCRLHMFKTGEGPGLLRFARSCSLGDLVSHLTLQALACLTCQGRYPPNQAAGEEEGSREWSRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 766054 - protein, 415 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVSRGRSQEKSLRQSRSRSRSKAGSRSRSRSRSKSKDKRKSRKRSREESRSRSRSRSKSERSRKRGSKRDSKAGSSKKKKKEDTDRSQSQVGEEVPSRRR

SEQ ID NO: 766055 - protein, 262 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSSCTSPVDCFLG

SEQ ID NO: 766056 - protein, 119 aa, Homo sapiens
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 766057 - protein, 119 aa, Homo sapiens; identical to SEQ ID NO: 766056

SEQ ID NO: 766058 - protein, 119 aa, Homo sapiens; identical to SEQ ID NO: 766056

SEQ ID NO: 766059 - protein, 119 aa, Homo sapiens; identical to SEQ ID NO: 766056

SEQ ID NO: 766060 - protein, 105 aa, Homo sapiens
MAEAVKHGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 766061 - protein, 200 aa, Homo sapiens
GGAVCGLSARQARTQLHTRLSRHLRPGFTQSSGEPRIHWRKALSVSRGNSQGYSEVCLGSLSCSSGTLMPRMILSNTTAVTPFLTKLWQETVQQGGNMSGLARRSPRSGDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 766062 - protein, 103 aa, Homo sapiens
AGAEVSGGDPDSASGSAMGQRSQEPEPLGQRRLCSQRPLASVLSKPSELQGRLKSLTHQTLGRDRARNPREFSLGSDSKTNDSSPARSPSLAVVSGHLTCSSQ

SEQ ID NO: 766063 - protein, 250 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 766064 - protein, 250 aa, Homo sapiens; identical to SEQ ID NO: 766063

SEQ ID NO: 766065 - protein, 225 aa, Homo sapiens
MSKFQVYSHRTFSPALTREKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 766066 - protein, 119 aa, Homo sapiens
VCLPVISAENWKPATTDQVIQSLIALVNDPQPEHPLRADLAEEYSKDRKKFCKNAEDVNVPLIKVIESEDYGQQLEIVCLIDPGCFREIDELIKKETKGKGSLEVLNLKDVEEGDEKFE

SEQ ID NO: 766067 - protein, 207 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQIVSKGEVQVFTIQKDKTHQQNGETGMVWGEPLGTKLVGLDPHMVVDASLDTIKQEPITPVESFDLERSPRHSANIPRKYGTATTLRRQGPKNQHAHVQDVILDEITTRNSNQHKGTPNKAL

SEQ ID NO: 766068 - protein, 152 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIIIVNHRYNSSLE

SEQ ID NO: 766069 - protein, 250 aa, Homo sapiens; identical to SEQ ID NO: 766063

SEQ ID NO: 766070 - protein, 278 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETNCKTAFGRSLVVFRDKALSSGDDSSHTCYFLALEDLAVGQYVEVEDPDPG

SEQ ID NO: 766071 - protein, 69 aa, Homo sapiens
EVQVSDKERHTQLEQMFRDIATIVADKCVNPETKRPYTVILIERAMKDIHYSVKTNKSTKQQVSGFSCH

SEQ ID NO: 766072 - protein, 198 aa, Homo sapiens
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQ

SEQ ID NO: 766073 - protein, 198 aa, Homo sapiens; identical to SEQ ID NO: 766072

SEQ ID NO: 766074 - protein, 198 aa, Homo sapiens; identical to SEQ ID NO: 766072

SEQ ID NO: 766075 - protein, 213 aa, Homo sapiens
ASFTQWLLHRGCRWSCLPVPRCGPVLLSPWVVDGTGRRGAGGCTRRVGSSAAQEPTERGRLRHGGLQVSSPVPQGGSQGPVTNRVQCPWASTAGGPSTHSAAAGPGAKPLIALGQQGRPAAPSAGPTKPTPTRNSSWPASPTRSPGSRWRFFLHTSLQAEGAGSSLGQPRKGLPQCSGGLKGSSSATKVGAQAEEALRASQGCEDCQHSVTSQ

SEQ ID NO: 766076 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 766077 - protein, 271 aa, Homo sapiens; identical to SEQ ID NO: 766076

SEQ ID NO: 766078 - protein, 271 aa, Homo sapiens; identical to SEQ ID NO: 766076

SEQ ID NO: 766079 - protein, 531 aa, Homo sapiens [sequence omitted]

SEQ ID NO: 766080 - protein, 424 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQDQLKRSEAEKLTLVTRVQQLQEAAGWTT

SEQ ID NO: 766081 - protein, 446 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQDQLKRSEAEKLTLVTRVQQLQGLLQNQSLQLQEQEKLLTKKGQQIYYHKF

SEQ ID NO: 766082 - protein, 449 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQDQLKRSEAEKLTLVTRVQQLQGLLQNQSLQLQEQEKLLTKKVQRTAFRIRQPQ

SEQ ID NO: 766083 - protein, 253 aa, Homo sapiens
EQRDELWAGASVVRWWCFWRADQRQGKTTQKQELKTSDRHQGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQDQLKRSEAEKLTLVTRVQQLQGLLQNQSLQLQEQEKLLTKKGQQIYYHKF

SEQ ID NO: 766084 - protein, 424 aa, Homo sapiens; identical to SEQ ID NO: 766080

SEQ ID NO: 766085 - protein, 531 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQDQLKRSEAEKLTLVTRVQQLQDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 766086 - protein, 424 aa, Homo sapiens; identical to SEQ ID NO: 766080

SEQ ID NO: 766087 - protein, 425 aa, Homo sapiens
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQELQAKIECLQGDRDLCSLDTQDLQGLLQNQSLQLQEQEKLLTKKGQQIYYHKF

SEQ ID NO: 766088 - protein, 106 aa, Homo sapiens
QRARLQQFFRRRNLELEEKGKAQHPQAREQGPSRRPGQVTVLKEPLSCARRISSPREQVGRVKGHTAVCSGTLSGQGGWVGSRSLKSDLNQVLLPQSYSKVAKSYL

SEQ ID NO: 766089 - protein, 84 aa, Homo sapiens
CIKFTEILPLGNEKSTTGDGRPELDNLSDEYLSCLRKLQHCREELNQSQQLPPRRQCGRWLPVLMVVIAAALAVFLANKDNLMI

SEQ ID NO: 766090 - protein, 446 aa, Homo sapiens; identical to SEQ ID NO: 766081

SEQ ID NO: 766091 - protein, 129 aa, Homo sapiens
MSSPNPLSKLHPKKASSSELPTVGKERMSLIYLQGADSRDLQMNQALRFLENEHQELQAKIECLQGDRDLCSLDTQDLQDQLKRSEAEKLTLVTRVQQLQGLLQNQSLQLQEQEKLLTKKGQQIYYHKF

SEQ ID NO: 766092 - protein, 551 aa, Homo sapiens [sequence omitted]

SEQ ID NO: 766093 - protein, 449 aa, Homo sapiens; identical to SEQ ID NO: 766082

SEQ ID NO: 766094 - protein, 106 aa, Homo sapiens
MRAYWPDVIHSFPNRSRFWKHEWEKHGTCAAQVDALNSQKKYFGRSLELYRELDLNRWVRPSPGCTSQWGSLLSPKPDSWIQGSGCRPHCPPAASACALFGYWDHS

SEQ ID NO: 766095 - protein, 88 aa, Homo sapiens
SILVFRFACFCVLIPPPLRLEDEEVQTIGQIELCLTKQDQQLQNCTEPGEQPSPKQEVWLANGAAESRGLRVCEDGPVFYPPPKKTKH

SEQ ID NO: 766096 - protein, 256 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 766097 - protein, 164 aa, Homo sapiens
MRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 766098 - protein, 164 aa, Homo sapiens; identical to SEQ ID NO: 766097

SEQ ID NO: 766099 - protein, 198 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNRWVRPSPGCTSQWGSLLSPKPDSWIQGSGCRPHCPPAASACALFGYWDHS

SEQ ID NO: 766100 - protein, 162 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNRLQILKMPLPEYME

SEQ ID NO: 766101 - protein, 158 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNRMRKYRQLVR

SEQ ID NO: 766102 - protein, 203 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVSLAFASFLVCLSRGPPVGPFQPLSQWAVNCPSANPLPT

SEQ ID NO: 766103 - protein, 169 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQELKAA

SEQ ID NO: 766104 - protein, 172 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSHQGRTIYCPVLKGVPPRSGRTFV

SEQ ID NO: 766105 - protein, 106 aa, Homo sapiens; identical to SEQ ID NO: 766094

SEQ ID NO: 766106 - protein, 111 aa, Homo sapiens
MRAYWPDVIHSFPNRSRFWKHEWEKHGTCAAQVDALNSQKKYFGRSLELYRELDLNSVLLKLGIKPSINYYQVSLAFASFLVCLSRGPPVGPFQPLSQWAVNCPSANPLPT

SEQ ID NO: 766107 - protein, 256 aa, Homo sapiens; identical to SEQ ID NO: 766096

SEQ ID NO: 766108 - protein, 256 aa, Homo sapiens; identical to SEQ ID NO: 766096

SEQ ID NO: 766109 - protein, 584 aa, Homo sapiens
SSESLPPGGSGRGQISFWGKPLTLAPCHRPGSVPPSFHFPPSLPPVPQPLAERRVLPAGIAGNTKRWFLFFKTSVSWEGVWRGRMSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 766110 - protein, 175 aa, Homo sapiens
MRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 766111 - protein, 284 aa, Homo sapiens
SSESLPPGGSGRGQISFWGKPLTLAPCHRPGSVPPSFHFPPSLPPVPQPLAERRVLPAGIAGNTKRWFLFFKTSVSWEGVWRGRMSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQVLGDERESPVTSRISNPIFLRNAGHASVAMNFWSLIKIFEIKSFIEL

SEQ ID NO: 766112 - protein, 161 aa, Homo sapiens [sequence omitted]

SEQ ID NO: 766113 - protein, 386 aa, Homo sapiens [sequence omitted]

SEQ ID NO: 766114 - protein, 130 aa, Homo sapiens
QHQQYCPGSWCFLRMRWAQPGGAAFSLAYAGLVALLVAAIFLCNGSVTLSLCRMYRQQKRHQGSLGPRPRTGEDEVDHLILLALMTVVMAVCSLPLTVSPLRSWEEWGEEEGSSVGCAHVTDGETEAQKR

SEQ ID NO: 766115 - protein, 290 aa, Homo sapiens
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 766116 - protein, 256 aa, Homo sapiens
MMPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEVRDEKDRSSKSYSFNRPTLPITG

SEQ ID NO: 766117 - protein, 290 aa, Homo sapiens; identical to SEQ ID NO: 766115

SEQ ID NO: 766118 - protein, 294 aa, Homo sapiens
MMPQEQYTHHRSTMPGSVGPQVYKVGIYGWRKRCLYFFVLLLMILILVNLAMTIWILKVMNFTISIHLLLRFKLAIQMLWNELRGARTRSQVTQIPVPTLLLDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEVRDEKDRSSKSYSFNRPTLPITG

SEQ ID NO: 766119 - protein, 78 aa, Homo sapiens
KPQAPWLASAKVAVGCPQASAWPPPPISYQEELYDFPSCGKWRARSQGSAEASQWPAPAAAPAAHSPHLSLGGKFFQG

SEQ ID NO: 766120 - protein, 78 aa, Homo sapiens; identical to SEQ ID NO: 766119

SEQ ID NO: 766121 - protein, 84 aa, Homo sapiens
LRLGTRLGGCFSMASASCSPGGALASPEPGRKILPRMISHSELRKLFYSADAVCFDVDSTVISEEGIGCFHWIWRKCDQATSQG

SEQ ID NO: 766122 - protein, 78 aa, Homo sapiens; identical to SEQ ID NO: 766119

SEQ ID NO: 766123 - protein, 397 aa, Homo sapiens
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 766124 - protein, 419 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 766125 - protein, 446 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 766126 - protein, 427 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 766127 - protein, 373 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKVLLCAQWP

SEQ ID NO: 766128 - protein, 414 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVTSLSLS

SEQ ID NO: 766129 - protein, 331 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVRCYLRFLDIY

SEQ ID NO: 766130 - protein, 251 aa, Homo sapiens
LHTLLGCVRSAGRGRLRLQGDTHPRGRMASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVFADLFDPVIKLRHNGYDPRVMKHTTDLDASKITQGQFDEHYVLSSRVRTGRSIRGLSLPPACTRAERREVENVAITALEGLKGDLAGRYYKLSEMTEQDQQRLIDA

SEQ ID NO: 766131 - protein, 874 aa, Homo sapiens
HPQLQHRAADQPVDMMSIKAFTLVSAVERELLMGDKERVNIECVECCGRDLYVGTNDCFVYHFLLEERPVPAGPATFTATKQLQRHLGFKKPVNELRAASALNRLLVLCDNSISLVNMLNLEPVPSGARIKGAATFALNENPVSGDPFCVEVCIISVKRRTIQMFLVYEDRVQIVKEVSTAEQPLAVAVDGHFLCLALTTQYIIHNYSTGVSQDLFPYCSEERPPIVKRIGRQEFLLAGPGGLGMFATVAGISQRAPVHWSENVIGAAVSFPYVIALDDEFITVHSMLDQQQKQTLPFKEGHILQDFEGRVIVATSKGVYILVPLPLEKQIQDLLASRRVEEALVLAKGARRNIPKEKFQVMYRRILQQAGFIQFAQLQFLEAKELFRSGQLDVRELISLYPFLLPTSSSFTRSHPPLHEYADLNQLTQGDQEKMAKCKRFLMSYLNEVRSTEVANGYKEDIDTALLKLYAEADHDSLLDLLVTENFCLLTDSAAWLEKHKKYFALGLLYHYNNQDAAAVQLWVNIVNGDVQDSTRSDLYEYIVDFLTYCLDEELVWAYADWVLQKSEEVGVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 766132 - protein, 630 aa, Homo sapiens
MFATVAGISQRAPVHWSENVIGAAVSFPYVIALDDEFITVHSMLDQQQKQTLPFKEGHILQDFEGRVIVATSKGVYILVPLPLEKQIQDLLASRRVEEALVLAKGARRNIPKEKFQVMYRRILQQAGFIQFAQLQFLEAKELFRSGQLDVRELISLYPFLLPTSSSFTRSHPPLHEYADLNQLTQGDQEKMAKCKRFLMSYLNEVRSTEVANGYKEDIDTALLKLYAEADHDSLLDLLVTENFCLLTDSAAWLEKHKKYFALGLLYHYNNQDAAAVQLWVNIVNGDVQDSTRSDLYEYIVDFLTYCLDEELVWAYADWVLQKSEEVGVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 766133 - protein, 874 aa, Homo sapiens; identical to SEQ ID NO: 766131

SEQ ID NO: 766134 - protein, 892 aa, Homo sapiens
SPGAAGRSGAAGPQAAGRRGTAGAGAADQPVDMMSIKAFTLVSAVERELLMGDKERVNIECVECCGRDLYVGTNDCFVYHFLLEERPVPAGPATFTATKQLQRHLGFKKPVNELRAASALNRLLVLCDNSISLVNMLNLEPVPSGARIKGAATFALNENPVSGDPFCVEVCIISVKRRTIQMFLVYEDRVQIVKEVSTAEQPLAVAVDGHFLCLALTTQYIIHNYSTGVSQDLFPYCSEERPPIVKRIGRQEFLLAGPGGLGMFATVAGISQRAPVHWSENVIGAAVSFPYVIALDDEFITVHSMLDQQQKQTLPFKEGHILQDFEGRVIVATSKGVYILVPLPLEKQIQDLLASRRVEEALVLAKGARRNIPKEKFQVMYRRILQQAGFIQFAQLQFLEAKELFRSGQLDVRELISLYPFLLPTSSSFTRSHPPLHEYADLNQLTQGDQEKMAKCKRFLMSYLNEVRSTEVANGYKEDIDTALLKLYAEADHDSLLDLLVTENFCLLTDSAAWLEKHKKYFALGLLYHYNNQDAAAVQLWVNIVNGDVQDSTRSDLYEYIVDFLTYCLDEELVWAYADWVLQKSEEVGVQVFTKRPLDEQQKNSFNPDDIINCLKKYPKALVKYLEHLVIDKRLQKEEYHTHLAVLYLEEVLLQRASASGKGAEATETQAKLRRLLQKSDLYRVHFLLERLQGAGLPMESAILHGKLGEHEKALHILVHELQDFAAAEDYCLWCSEGRDPPHRQQLFHTLLAIYLHAGPTAHELAVAAVDLLNRHATEFDAAQVLQMLPDTWSVQLLCPFLMGAMRDSIHARRTMQVALGLARSENLIYTYDKMKLKGSSIQLSDKKLCQICQNPFCEPVFVRYPNGGLVHTHCAASRHTNPSSSSPGTRT

SEQ ID NO: 766135 - protein, 275 aa, Homo sapiens
SPGAAGRSGAAGPQAAGRRGTAGAGAADQPVDMMSIKAFTLVSAVERELLMGDKERVNIECVECCGRDLYVGTNDCFVYHFLLEERPVPAGPATFTATKQLQRHLGFKKPVNELRAASALNRLLVLCDNSISLVNMLNLEPVPSGARIKGAATFALNENPVSGDPFCVEVCIISVKRRTIQMFLVYEDRVQIVKEVSTAEQPLAVAVDGHFLCLALTTQYIIHNYSTGVSQDLFPYCSEERPPIVKRIGRQEFLLAGPGGLGEEDAFVRLIFLGG

SEQ ID NO: 766136 - protein, 892 aa, Homo sapiens; identical to SEQ ID NO: 766134

SEQ ID NO: 766137 - protein, 874 aa, Homo sapiens; identical to SEQ ID NO: 766131

SEQ ID NO: 766138 - protein, 892 aa, Homo sapiens; identical to SEQ ID NO: 766134

SEQ ID NO: 766139 - protein, 125 aa, Homo sapiens
MCHFPQVLRTLKPWREMHLELFTFRQSSSGCLQLVTRWPIVLPCFSPLSLGQVVSLINPNHENSLLKEFTLKMPQNRQWKNEMNKCESIILLRFWKNAGFQLLENSHKTSVLFYIFICFHSSFLL

SEQ ID NO: 766140 - protein, 419 aa, Homo sapiens
FIKDSLLQPLTLTLLRSNSAHLRVSSRQLWKELCVSPAMHLLAILFCALWSAVLAENSDDYDLMYVNLDNEIDNGLHPTEDPTPCDCGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 766141 - protein, 411 aa, Homo sapiens
AGTVWDLGINSAHLRVSSRQLWKELCVSPAMHLLAILFCALWSAVLAENSDDYDLMYVNLDNEIDNGLHPTEDPTPCDCGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 766142 - protein, 296 aa, Homo sapiens
FIKDSLLQPLTLTLLRSNSAHLRVSSRQLWKELCVSPAMHLLAILFCALWSAVLAENSDDYDLMYVNLDNEIDNGLHPTEDPTPCDCGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIFFFFFLYYNKLFS

SEQ ID NO: 766143 - protein, 457 aa, Homo sapiens
GAALRNKVEAQSAGLHPGAPGLVLAVGAVAVDERHRRESEMAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 766144 - protein, 192 aa, Homo sapiens
MQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGEGRKDIGVIFHSLKATFFNYFFI

SEQ ID NO: 766145 - protein, 259 aa, Homo sapiens
MRIPMRDASINVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 766146 - protein, 128 aa, Homo sapiens
CVRVHVRVCVSGADPGCEDGLPILPFSWLPYPSLLLAASHCDMDFSLIFLSLLPLQHERPSTCKTTRLHHSPERPVLPLRKGLDQRKSHHHDVPNCSARVCVGYFQLSPAKPASSPPPEPCGVSGASP

SEQ ID NO: 766147 - protein, 107 aa, Homo sapiens
LPIGGTKEDRKAVGGNRELLLPILSVAPAGIYCHVVYSSITGCLQLSSFFHHSQDQLLCNLSEAPAPARWHPPLDSDSQTLLQPPEVVQETSGTLRVLRPSLAGLLL

SEQ ID NO: 766148 - protein, 157 aa, Homo sapiens
MSKSCGNNLAAISVGISLLLLLVVCGIGCVWHWKHRVATRFTLPRFLQRRSSRRKVCTKTFLGPRIIGLRHEISVETQDHKSAVRGNNTHDNYENVEAGPPKAKGKTDKELYENTGQSNFEEHIYGNETSSDYYNFQKPRPSEVPQDEDIYILPDSY

SEQ ID NO: 766149 - protein, 157 aa, Homo sapiens; identical to SEQ ID NO: 766148

SEQ ID NO: 766150 - protein, 139 aa, Homo sapiens
MSKSCGNNLAAISVGISLLLLLVVCGIGCVWHWKHRVATRFTLPRFLQRRSSRRKVCTNQDHKSAVRGNNTHDNYENVEAGPPKAKGKTDKELYENTGQSNFEEHIYGNETSSDYYNFQKPRPSEVPQDEDIYILPDSY

SEQ ID NO: 766151 - protein, 157 aa, Homo sapiens; identical to SEQ ID NO: 766148

SEQ ID NO: 766152 - protein, 157 aa, Homo sapiens; identical to SEQ ID NO: 766148

SEQ ID NO: 766153 - protein, 235 aa, Homo sapiens
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDQSLTLAGSCLQKPH

SEQ ID NO: 766154 - protein, 86 aa, Homo sapiens
TESRSVTRLVCSGAISAHCNLRFPGSSNSPASASRVAGITGPCHHAQLIFLFLVETRFHHVGQAGLDLMTSWIHPPQPPKVLGLQA

SEQ ID NO: 766155 - protein, 1008 aa, Homo sapiens
IWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLQDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVHEEPRKPNCQGSCKSQRPMFPPIHKSEKFRKPNLEKHEERLEGLRTPQLTPVRKTEDTHQDEGVQLLPSKKQPPSVSPFGENIKQIFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 766156 - protein, 176 aa, Homo sapiens
NRTESSPSCVRQLLWKPHGQEAPGQHILSACVCCTSSGTGAMSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKGTVPGTEASGFDAP

SEQ ID NO: 766157 - protein, 193 aa, Homo sapiens
NRTESSPSCVRQLLWKPHGQEAPGQHILSACVCCTSSGTGAMSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAP

SEQ ID NO: 766158 - protein, 851 aa, Homo sapiens
RLPPPPLGPAPRPLRGPRPPACPPPPWRPGSPLHGATRTLGVPSPPPPCPLSRRADPGVLGAQLLSSRPQAGGGGGEERGPWDPRPPHPAAPAPRDPEKMSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 766159 - protein, 351 aa, Homo sapiens
MVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 766160 - protein, 138 aa, Homo sapiens
VSSSADLQTDPKVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 766161 - protein, 65 aa, Homo sapiens
NLEVILTDIVRMAHTEIATHVRNSQVPTIPQSQFWVSVVMPALNGTPSPRWPIPCTPAPQTQPDE

SEQ ID NO: 766162 - protein, 787 aa, Homo sapiens
RLPPPPLGPAPRPLRGPRPPACPPPPWRPGSPLHGATRTLGVPSPPPPCPLSRRADPGVLGAQLLSSRPQAGGGGGEERGPWDPRPPHPAAPAPRDPEKMSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 766163 - protein, 670 aa, Homo sapiens
RLPPPPLGPAPRPLRGPRPPACPPPPWRPGSPLHGATRTLGVPSPPPPCPLSRRADPGVLGAQLLSSRPQAGGGGGEERGPWDPRPPHPAAPAPRDPEKMSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRVTLDPSKRQNSNRCVSGASLPQGSKIRSQTNLRESGDLRSQVAIYLGIKRKPPPGCSDSPGV

SEQ ID NO: 766164 - protein, 467 aa, Homo sapiens
RLPPPPLGPAPRPLRGPRPPACPPPPWRPGSPLHGATRTLGVPSPPPPCPLSRRADPGVLGAQLLSSRPQAGGGGGEERGPWDPRPPHPAAPAPRDPEKMSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTTCCPINLGESPPPQC

SEQ ID NO: 766165 - protein, 110 aa, Homo sapiens
SARGATSRPRLFPVRGSCHFRLFPPRVPISCVCSRVPETAPKMNTRGFRVGTNLKRQWPALSGLRWLLRLGLLLRLQGRPLHGFLPSQVSRGQLLPGGARNRILSGAAAC

SEQ ID NO: 766166 - protein, 110 aa, Homo sapiens; identical to SEQ ID NO: 766165

SEQ ID NO: 766167 - protein, 42 aa, Homo sapiens
LHTGPHPSGTSNANVPSAIPDCKFEMSLPAITEEAKVHSGCM

SEQ ID NO: 766168 - protein, 475 aa, Homo sapiens
AGGGGLLAGPAQRKSQASMSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 766169 - protein, 504 aa, Homo sapiens
RGVGMVGRSCGVATQRQGGGQRPTNLALTLSSSPAHSTALPWLPPRSLQLLSGHSVPAQPTPHLPSACGGPTRVTLGEERAWRSHGSNAGGHTCLPRRTAGAGSLTPGGERGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 766170 - protein, 475 aa, Homo sapiens; identical to SEQ ID NO: 766168

SEQ ID NO: 766171 - protein, 475 aa, Homo sapiens; identical to SEQ ID NO: 766168

SEQ ID NO: 766172 - protein, 486 aa, Homo sapiens
AGGGGLLAGPAQRKSQASMSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVCIITVFSALSVKWVGVGKSRESMIQLF

SEQ ID NO: 766173 - protein, 526 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVICFCLLKANWKWSHKTTDGMSDECEDTSIHTREMPQIWVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 766174 - protein, 488 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 766175 - protein, 415 aa, Homo sapiens
MQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 766176 - protein, 167 aa, Homo sapiens
MTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 766177 - protein, 277 aa, Homo sapiens
MKEQLRREQQEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 766178 - protein, 134 aa, Homo sapiens
ASPAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGW

SEQ ID NO: 766179 - protein, 421 aa, Homo sapiens
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 766180 - protein, 421 aa, Homo sapiens; identical to SEQ ID NO: 766179

SEQ ID NO: 766181 - protein, 421 aa, Homo sapiens; identical to SEQ ID NO: 766179

SEQ ID NO: 766182 - protein, 244 aa, Homo sapiens
ASPCRGRSRAAHPGRRRGRRRGPRSGPVCEAPGRRRSGRIVERGGGARPRAPARSSEGFPAPTACGMARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDGVSLCCPDSGDK

SEQ ID NO: 766183 - protein, 1009 aa, Homo sapiens
ASPCRGRSRAAHPGRRRGRRRGPRSGPVCEAPGRRRSGRIVERGGGARPRAPARSSEGFPAPTACGMARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRAPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 766184 - protein, 104 aa, Homo sapiens
ASPCRGRSRAAHPGRRRGRRRGPRSGPVCEAPGRRRSGRIVERGGGARPRAPARSSEGFPAPTACGMARGSALPRRPLLCIPAVWAAAALLLSVSRTSGATQDS

SEQ ID NO: 766185 - protein, 945 aa, Homo sapiens
MKSDEMNKLSDSHPVEEIELHPQFLCSFLDLVFQGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRAPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 766186 - protein, 789 aa, Homo sapiens
MILRPPQPCELDDYHEDGFCQPYRGIACARFIGNRTIYVDSLQMQGEIENRITAAFTMIGTSTHLSDQCSQFAIPSFCHFVFPLCDARSRAPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 766187 - protein, 191 aa, Homo sapiens
ASPCRGRSRAAHPGRRRGRRRGPRSGPVCEAPGRRRSGRIVERGGGARPRAPARSSEGFPAPTACGMARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQRTAQIITFSKYLFSPSHVLLL

SEQ ID NO: 766188 - protein, 123 aa, Homo sapiens
GWRRAGGAFRPRSARDLWGSPEAPGMCETLLTSKWASVSPIPALLQEGENRDSRRLGDALLFLRPAGSCALQVSWPAALAGPRSHTGQLTQHFCHLKNDTCIPPSLGPPRNSGSLESLRSKRY

SEQ ID NO: 766189 - protein, 968 aa, Homo sapiens
MCETLLTSKWASVSPIPALLQEGENRDSRRLGDALLFLRPAGSCALQVSWPAALAGQGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRAPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 766190 - protein, 110 aa, Homo sapiens [sequence omitted]

SEQ ID NO: 766191 - protein, 301 aa, Homo sapiens
RVGQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRSRLKCAIKDDLGSLQK

SEQ ID NO: 766192 - protein, 290 aa, Homo sapiens
RVGQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGGAGQEESQPTILRLGAHRPAPVSRLKCAIKDDLGSLQK

SEQ ID NO: 766193 - protein, 429 aa, Homo sapiens
RVGQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 766194 - protein, 239 aa, Homo sapiens
RVGQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKMVPS

SEQ ID NO: 766195 - protein, 435 aa, Homo sapiens
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 766196 - protein, 417 aa, Homo sapiens
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEVSWGGQMGHYPAPRDRLLGAGRARAEVAATRRPQSFLGLLPQPWGGKGRLQSSA

SEQ ID NO: 766197 - protein, 446 aa, Homo sapiens
MTVTSWREELRMKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 766198 - protein, 435 aa, Homo sapiens; identical to SEQ ID NO: 766195

SEQ ID NO: 766199 - protein, 435 aa, Homo sapiens; identical to SEQ ID NO: 766195

SEQ ID NO: 766200 - protein, 179 aa, Homo sapiens
MWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 766201 - protein, 102 aa, Homo sapiens
VEGHSNVWSRAEVAAPQPWREAAAAAAAARVAALGGGGERLARLQPGPGPPGGRAEQPRLCATCGNNSLSRGHQHCCHFFQPQPKAWLSGLGPVVLDSPGPQ

SEQ ID NO: 766202 - protein, 435 aa, Homo sapiens; identical to SEQ ID NO: 766195

SEQ ID NO: 766203 - protein, 435 aa, Homo sapiens; identical to SEQ ID NO: 766195

SEQ ID NO: 766204 - protein, 300 aa, Homo sapiens
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPDAVHAR

SEQ ID NO: 766205 - protein, 265 aa, Homo sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 766206 - protein, 170 aa, Homo sapiens
MNRFLLLMSLYLLGSARGTSSQPNELSGSIDHQTSVQQLPGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 766207 - protein, 195 aa, Homo sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 766208 - protein, 246 aa, Homo sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGTILNCYTCAYMNDQGKCLRGEGTCITQNSQQCMLKKIFEGGKLQFMVQGCENMCPSMNLFSHGTRMQIICCRNQSFCNKI

SEQ ID NO: 766209 - protein, 210 aa, Homo sapiens
MNRFLLLMSLYLLGSARGTSSQPNELSGSIDHQTSVQQLPGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 766210 - protein, 121 aa, Homo sapiens
MNRFLLLMSLYLLGSARGTSSQPNELSGSIDHQTSVQQLPGTILNCYTCAYMNDQGKCLRGEGTCITQNSQQCMLKKIFEGGKLQFMVQGCENMCPSMNLFSHGTRMQIICCRNQSFCNKI

SEQ ID NO: 766211 - protein, 155 aa, Homo sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGGKLQFMVQGCENMCPSMNLFSHGTRMQIICCRNQSFCNKI

SEQ ID NO: 766212 - protein, 142 aa, Homo sapiens
EGRVGPAQVLSPPRPAMPTGPKRMQDPPRDSAPNPTHARHHSNCDSGGPCRGEGGASGDRQGGHVPSSCGRSWDALVAPGGTCPHTHTDTHTHTHTRDFGKLCLRDRGWGWGFFFHYLSSFESSLPFLFLSISLLSSFFKKI

SEQ ID NO: 766213 - protein, 1494 aa, Homo sapiens
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQAESSNSSSRSNKEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 766214 - protein, 106 aa, Homo sapiens
MENRPGSFQYVPVQLQGGAPWGFTLKGGLEHCEPLTVSKIEDGGKAALSQKMRTGDELVNINGTPLYGSRQEALILIKGSFRILKLIVRRLSLLAPGIKHSPKRRP

SEQ ID NO: 766215 - protein, 1476 aa, Homo sapiens
MENRPGSFQYVPVQLQGGAPWGFTLKGGLEHCEPLTVSKIEDGGKAALSQKMRTGDELVNINGTPLYGSRQEALILIKGSFRILKLIVRRRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQAESSNSSSRSNEEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 766216 - protein, 1378 aa, Homo sapiens
MHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQEFPGDKWNPITGNRKTSQSGREMAHSKTSFSWATPFHPCLENPALDLSSYRAISSLDLLGDFKHALKKSEETSVYEEGSSLASMPHPLRSRAFSESHISLAPQSTRAWGQHRRELFSKGDETQSDLLGARKKAFPPPRPPPPNWEKYRLFRAAQQAESSNSSSRSNEEEEEEEEEEEEEEEEEEEEEAEEEEEELPPQYFSSETSGSCALNPEEVLEQPQPLSFGHLEGSRQGSQSVPAEQESFALHSSDFLPPIRGHLGSQPEQAQPPCYYGIGGLWRTSGQEATESAKQEFQHFSPPSGAPGIPTSYSAYYNISVAKAELLNKLKDQPEMAEIGLGEEEVDHELAQKKIQLIESISRKLSVLREAQRGLLEDINANSALGEEVEANLKAVCKSNEFEKYHLFVGDLDKVVNLLLSLSGRLARVENALNSIDSEANQEKLVLIEKKQQLTGQLADAKELKEHVDRREKLVFGMVSRYLPQDQLQDYQHFVKMKSALIIEQRELEEKIKLGEEQLKCLRESLLLGPSNF

SEQ ID NO: 766217 - protein, 251 aa, Homo sapiens
MELLIMINACKIASASRVTAVIPCFPYARQDKKDKSRSPISAKLVANMLSIAGADHIITMDLHASQIQGFFDIPVDNLYAEPTVLKWIRENIPEWKNCIIVSPDAGGAKRVTSIADQLNVDFALIHKERKKANEVDCIVLVGDVNDRVAILVDDMADTCVTICLAADKLLSAGATRVYAILTHGIFSGPAISRINTACFEAVVVTNTIPQDEKMKHCSKIRVIDISMILAEAIRRTHNGESVSYLFSHVPL

SEQ ID NO: 766218 - protein, 137 aa, Homo sapiens
PKHQSSDIHCRSKMGLRVLPFLAYLLSLHRFCESPPTHKRSFFLRAPLTRHKCLSYKVFRCTLVFMSPGFFTKLCDSWALSPPSSYMQRLSQSRLIFVEGSCGSALRATGRTPLIQPYRGRCGSRHWLPCPPLVSLS

SEQ ID NO: 766219 - protein, 82 aa, Homo sapiens
PAGTCECWCLEGGPGCAELWGAGPHSSPDRAPGASSINQGSVLPARFEGFLLGVWVLSASCCVWRLLSTGCPSRVWVPGQPS

SEQ ID NO: 766220 - protein, 70 aa, Homo sapiens
AAAYYYYCSEFKLLTMYGPMLMPRVTLATRWAPKPPLPLFLPPIPHLVLTNPASLSGPGCRDLGSLSPSL

SEQ ID NO: 766221 - protein, 205 aa, Homo sapiens
NKNVWLGTRLGGLIGRGAASPLDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHILQSSKEENEKQKRDKEDNQ

SEQ ID NO: 766222 - protein, 122 aa, Homo sapiens
GAHTVNPPRLLFGRKALGVLEAPRCSHLAGLRSLRVCPTFSLSSFTFEKPRFRFWSQRPRRPRRGDGGAVGGGDLWLLVPPPTLLFCTAVLRKTFSPALFPSPSLCIAPDLAGRRLGRREML

SEQ ID NO: 766223 - protein, 103 aa, Homo sapiens
GAHTVNPPRLLFGRKALGVLEAPRCSHLAGLRSLRVCPTFSLSSFTFEKPRFRFWSQRPRRPRRGDGGAVGGGDLWLLVPPPTLLFCTAVLRKTFSPALFPSL

SEQ ID NO: 766224 - protein, 281 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 766225 - protein, 281 aa, Homo sapiens; identical to SEQ ID NO: 766224

SEQ ID NO: 766226 - protein, 281 aa, Homo sapiens; identical to SEQ ID NO: 766224

SEQ ID NO: 766227 - protein, 281 aa, Homo sapiens; identical to SEQ ID NO: 766224

SEQ ID NO: 766228 - protein, 281 aa, Homo sapiens; identical to SEQ ID NO: 766224

SEQ ID NO: 766229 - protein, 122 aa, Homo sapiens
RKGGVVALAPLPRGPHGALLPFGSSVAPGPKGQETTSGLILLSHVGTFLRDRWTLTSLWPCPRALLVFLSHSCEVMGAGAPGVSLPEGQLSPLPWLQVGRSSRRAPDSGQGPLGPPGLQMFL

SEQ ID NO: 766230 - protein, 281 aa, Homo sapiens; identical to SEQ ID NO: 766224

SEQ ID NO: 766231 - protein, 82 aa, Homo sapiens
ESRKLSARYEAWVVLTSLWPCPRALLVFLSHSCEVMGAGAPGVSLPEGQLSPLPWLQVGRSSRRAPDSGQGPLGPPGLQMFL

SEQ ID NO: 766232 - protein, 281 aa, Homo sapiens; identical to SEQ ID NO: 766224

SEQ ID NO: 766233 - protein, 281 aa, Homo sapiens; identical to SEQ ID NO: 766224

SEQ ID NO: 766234 - protein, 281 aa, Homo sapiens; identical to SEQ ID NO: 766224

SEQ ID NO: 766235 - protein, 181 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHCKVMYGVQLLAEDGVLTFALVEAYPHLVLLSQLQHQA

SEQ ID NO: 766236 - protein, 142 aa, Homo sapiens
PDQPPHSPWLKKKEHLLSHCTPSPPRIVAHIPKMWKDFSFPSGTCSSPPFGDLTIAAKAMHPVGLRKPQCLQPCLRAAASLIFHHLPCLQGYLLTGLECKFQRLLLKIPQVKQARCLDLLLSLTCNILFRGSEHLLGCYLMC

SEQ ID NO: 766237 - protein, 461 aa, Homo sapiens
FVDTEEMTGTHLHRTIKTYLQQIGVDMDKIHGQAYDSTTNLKIKFNKIAAEFKKEEPRALYIHCYAHFLDLSIIRFCKEVKELRSALKTLSSLFNTICMSGEMLANFRNIYRLSQNKTCKKHISQSCWTVHDRTLLSVIDSLPEIIETLEVIASHSSNTSFADELSHLLTLVSKFEFVFCLKFLYRVLSVTGILSKELQNKTIDIFSLSSKIEAILECLSSERNDVYFKTIWDGTEEICQKITCKGFKVEKPSLQKRRKIQKSVDLGNSDNMFFPTSTEEQYKINIYYQGLDTILQNLKLCFSEFDYCKIKQISELLFKWNEPLNETTAKHVQEFYKLDEDIIPELRFYRHYAKLNFVIDDSCINFVSLGCLFIQHGLHSNIPCLSKLLYIALSWPITSASTENSFSTLPRLKTYLCNTMGQEKLTGPALMAVEQELVNKLMEPERLNEIVEKFISQMKEI

SEQ ID NO: 766238 - protein, 461 aa, Homo sapiens; identical to SEQ ID NO: 766237

SEQ ID NO: 766239 - protein, 533 aa, Homo sapiens
MNESPDPTDLAGVIIELGPNDSPQTSEFKGATEEAPAKESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGPPLYDDVKVQFFSSNLPTYYDNCSFYFWLHTSFIENNRLYLPKNELDNLHKQKARRIYPSDFAVEILFGEKMTSSDVVAGSD

SEQ ID NO: 766240 - protein, 551 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGPPLYDDVKVQFFSSNLPTYYDNCSFYFWLHTSFIENNRLYLPKNELDNLHKQKARRIYPSDFAVEILFGEKMTSSDVVAGSD

SEQ ID NO: 766241 - protein, 487 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGPPLYDDVKVQFFSSSLPT

SEQ ID NO: 766242 - protein, 483 aa, Homo sapiens
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 766243 - protein, 483 aa, Homo sapiens; identical to SEQ ID NO: 766242

SEQ ID NO: 766244 - protein, 483 aa, Homo sapiens; identical to SEQ ID NO: 766242

SEQ ID NO: 766245 - protein, 483 aa, Homo sapiens; identical to SEQ ID NO: 766242

SEQ ID NO: 766246 - protein, 483 aa, Homo sapiens; identical to SEQ ID NO: 766242

SEQ ID NO: 766247 - protein, 483 aa, Homo sapiens; identical to SEQ ID NO: 766242

SEQ ID NO: 766248 - protein, 316 aa, Homo sapiens
MVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 766249 - protein, 287 aa, Homo sapiens
MATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 766250 - protein, 303 aa, Homo sapiens [sequence omitted]

SEQ ID NO: 766251 - protein, 249 aa, Homo sapiens
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEAR

SEQ ID NO: 766252 - protein, 76 aa, Homo sapiens
FTLIFIFYSLKFLNTCFLGRFGHLGLAINLITYDDRFNLKSIEEQLGTEIKPIPSNIDKSLYVAEYHSEPVEDEKP

SEQ ID NO: 766253 - protein, 227 aa, Homo sapiens [sequence omitted]

SEQ ID NO: 766254 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766255 - protein, 478 aa, Homo sapiens; identical to SEQ ID NO: 766254

SEQ ID NO: 766256 - protein, 478 aa, Homo sapiens; identical to SEQ ID NO: 766254

SEQ ID NO: 766257 - protein, 320 aa, Homo sapiens
MLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766258 - protein, 478 aa, Homo sapiens; identical to SEQ ID NO: 766254

SEQ ID NO: 766259 - protein, 301 aa, Homo sapiens
EIFIYDNCEKKEKGLRRTDSLLEPAKQKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766260 - protein, 478 aa, Homo sapiens; identical to SEQ ID NO: 766254

SEQ ID NO: 766261 - protein, 478 aa, Homo sapiens; identical to SEQ ID NO: 766254

SEQ ID NO: 766262 - protein, 478 aa, Homo sapiens; identical to SEQ ID NO: 766254

SEQ ID NO: 766263 - protein, 421 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGKNSERGHDRGVKNAEGLEFNKEYVAGHSGAHLQSQLLRMLRWDDHLSPGVLKSILGNMARPLSLKNKTNKKEYIVSPIERSVSFKNNVS

SEQ ID NO: 766264 - protein, 137 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGSPYRRTNVVTK

SEQ ID NO: 766265 - protein, 478 aa, Homo sapiens; identical to SEQ ID NO: 766254

SEQ ID NO: 766266 - protein, 478 aa, Homo sapiens; identical to SEQ ID NO: 766254

SEQ ID NO: 766267 - protein, 486 aa, Homo sapiens
TQYNSVLPFKLSASLNFCGHGTKNAIFSFTKEKSCNIFDPQHGAQEAKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766268 - protein, 297 aa, Homo sapiens
LTIDNIRKRKTYLQQLSYFPPLHKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766269 - protein, 153 aa, Homo sapiens
DLLEVSHTTPTGLPYTVLGSSHLCWEDDWYTQHSVLDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 766270 - protein, 478 aa, Homo sapiens; identical to SEQ ID NO: 766254

SEQ ID NO: 766271 - protein, 273 aa, Homo sapiens
RPGSHGGGAAAGAGSARPFLPPPPRTAPRRAGRCQLPQRPAEARCMLSRCRSRLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 766272 - protein, 213 aa, Homo sapiens
RPGSHGGGAAAGAGSARPFLPPPPRPAPRRAGRCQLPQRPAEARCMLSRCRSRLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEVMKIFICPHRL

SEQ ID NO: 766273 - protein, 273 aa, Homo sapiens; identical to SEQ ID NO: 766271

SEQ ID NO: 766274 - protein, 273 aa, Homo sapiens; identical to SEQ ID NO: 766271

SEQ ID NO: 766275 - protein, 273 aa, Homo sapiens; identical to SEQ ID NO: 766271

SEQ ID NO: 766276 - protein, 273 aa, Homo sapiens; identical to SEQ ID NO: 766271

SEQ ID NO: 766277 - protein, 273 aa, Homo sapiens; identical to SEQ ID NO: 766271

SEQ ID NO: 766278 - protein, 94 aa, Homo sapiens
RLPSIFRTLRRLLTNETWLVERTVVCRRETTTLVCMRTLTDKRESLEKRIQTYLQSTKPIIDLYEEMGKVKKIDASKSVDEVFDEVVQIFDKEG

SEQ ID NO: 766279 - protein, 273 aa, Homo sapiens; identical to SEQ ID NO: 766271

SEQ ID NO: 766280 - protein, 103 aa, Homo sapiens
RPGSHGGGAAAGAGSARPFLPPPPRPAPRRAGRCQLPQRPAEARCMLSRCRSRLLHVLGLSFLLQTRRPILLCSPRLMKPLVVFVLGGPGAGKGTQCARIVEG

SEQ ID NO: 766281 - protein, 273 aa, Homo sapiens; identical to SEQ ID NO: 766271

SEQ ID NO: 766282 - protein, 273 aa, Homo sapiens; identical to SEQ ID NO: 766271

SEQ ID NO: 766283 - protein, 147 aa, Homo sapiens
RPGSHGGGAAAGAGSARPFLPPPPRTAPRRAGRCQLPQRPAEARCMLSRCRSRLLHVLGLSFLLQTRRPILLCSPRLMKPLVVFVLGGPGAGKGTQCARIVEKYGYTHLSAGELLRDERKNPDSQYGELIEKKWIRQWLPMLRRINS

SEQ ID NO: 766284 - protein, 237 aa, Homo sapiens
RPGSHGGGAAAGAGSARPFLPPPPRTAPRRAGRCQLPQRPAEARCMLSRCRSRLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKSREFSSSRRP

SEQ ID NO: 766285 - protein, 183 aa, Homo sapiens
QHGHKFPGCSFCLVYPRVEEASNLKMPMDTDKGSLNKSLPSKAKRPKKRQNRKTKNFLNNNHTRPAKYHRGKQTNKQNWLQLHSCQQRSSVEPRLLHSCGCNDATQYPLPRWCQRRPRMELSFSYPLTSKEPPLTLGFSRVHMESLAFHTHPRVTRGPSSSQWGWCQRGLQQLDMHAQKEKIK

SEQ ID NO: 766286 - protein, 377 aa, Homo sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPGQNKISRFLLYMKNLLNRIIDDMVEQ

SEQ ID NO: 766287 - protein, 38 aa, Homo sapiens
MPQRRARAFNTVACGESGHAGPLCGRPSSAAAHIVRTS

SEQ ID NO: 766288 - protein, 38 aa, Homo sapiens; identical to SEQ ID NO: 766287

SEQ ID NO: 766289 - protein, 69 aa, Homo sapiens
CFFSGKGSGGLNLGNFFASRKGYSRKGFDRLSTEGSDQEKEDDGVNQKRSIQHLCLRSHLPPPENQALI

SEQ ID NO: 766290 - protein, 78 aa, Homo sapiens
VNIPVDVTANSLHQVPDTSLGRGGKGGSSGTDCLGWRSDLPKVVSNYLCDLEQSTELHLCKMGRIIILLHRIVIRYKR

SEQ ID NO: 766291 - protein, 64 aa, Homo sapiens
LPTSVSLFDDEDEEDNLFGRTAAKRQTLCLQAQREEKAKASELSKKKASALLFSSDEEVSSGFC

SEQ ID NO: 766292 - protein, 857 aa, Homo sapiens
MESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQAKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 766293 - protein, 119 aa, Homo sapiens [sequence omitted]

SEQ ID NO: 766294 - protein, 103 aa, Homo sapiens
MWSVCALGCSTAMGMNSLLRHTSTWVASGTLRQAGDARHRVHPERVCSCPSSETQEATCAVAAHGDASFLVHPTALIAVRDPLPESPCCQPLPFQGALWTLLP

SEQ ID NO: 766295 - protein, 437 aa, Homo sapiens
MACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 766296 - protein, 427 aa, Homo sapiens
MLLMVVSMACVGFFLVQRAGPHVGGQDKPFLSAWPSAVVPRGGHVTLRCHYRHRFNNFMLYKEDRIHVPIFHGRLFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 766297 - protein, 349 aa, Homo sapiens
MLLMVVSMACVGFFLVQRAGPHVGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 766298 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766299 - protein, 983 aa, Homo sapiens
MGMVTGWVGSGCVPLRLSLLPQGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766300 - protein, 1003 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766301 - protein, 418 aa, Homo sapiens
MGEVSTEERRTEATGEAGSAGSLQAAVVKRGRGQEGLVQVPGVSCLCPHPPSREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766302 - protein, 1020 aa, Homo sapiens; identical to SEQ ID NO: 766298

SEQ ID NO: 766303 - protein, 1020 aa, Homo sapiens; identical to SEQ ID NO: 766298

SEQ ID NO: 766304 - protein, 1020 aa, Homo sapiens; identical to SEQ ID NO: 766298

SEQ ID NO: 766305 - protein, 257 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGEKPGCPL

SEQ ID NO: 766306 - protein, 160 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFWSLPGPAASFLATTSFPFTGQLLGLATLAWLSFLHFQFPLPHFPGLALFR

SEQ ID NO: 766307 - protein, 1020 aa, Homo sapiens; identical to SEQ ID NO: 766298

SEQ ID NO: 766308 - protein, 500 aa, Homo sapiens
RYPPDQPDREMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766309 - protein, 1020 aa, Homo sapiens; identical to SEQ ID NO: 766298

SEQ ID NO: 766310 - protein, 165 aa, Homo sapiens
MIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 766311 - protein, 1061 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGKPLHIPPSKVQAPPPAPPSRTTRRLHSHYWFLLLFLNTLRSWGPRSQEP

SEQ ID NO: 766312 - protein, 109 aa, Homo sapiens
ASAEAQASRYWPPILPSILASPMPEFKELQWLLPWKGPGHGGLLPTDSEKKLSICKERPTPALGHSPLSLLLREASVPCPSSPSLAQLFVPSACVPFHSDLKHNLALLS

SEQ ID NO: 766313 - protein, 224 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 766314 - protein, 168 aa, Homo sapiens
MYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 766315 - protein, 253 aa, Homo sapiens
GHAPGGWSRAGRRAGSSAFRGGGSGGDGDMESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 766316 - protein, 253 aa, Homo sapiens; identical to SEQ ID NO: 766315

SEQ ID NO: 766317 - protein, 159 aa, Homo sapiens
MSTHASGMSGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSGICLWHLHLILGEALTLGFRSWEGLGLSGRGREQLTPPGHF

SEQ ID NO: 766318 - protein, 203 aa, Homo sapiens
MESGAYGAAKAGGSFDLRRFLTQPQVVARAVCLEAEDAVSRDRTIALQPGQQEQDSISNNNKNPKGDSSSGRGQHLYTPSGSPLCVPLRRHQPYQVLPSRQVFALIVFSCIYGEGYSNAHESKQMYCVFNRNEDACRYGSAIGVLAFLASAFFLVVDAYFPQISNATDRKYLVIGDLLFSGCAGLPGLPALQGWRGRLHPELR

SEQ ID NO: 766319 - protein, 215 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWRYKAGVDDFIQNYVDPTPDPNTAYASYPGASVDNYQQPPFTQNAETTEGYQPPPVY

SEQ ID NO: 766320 - protein, 105 aa, Homo sapiens
MIWGPPPCAGGLWAASRGVRAGLVLMALPPCSHPWQQGRALPDNTQLYVNILQLLLRKPGEGRGAPWLPDSVCAECIIKSWGRCPAWDAVWRRNKCFLIQSPVIG

SEQ ID NO: 766321 - protein, 105 aa, Homo sapiens; identical to SEQ ID NO: 766320

SEQ ID NO: 766322 - protein, 253 aa, Homo sapiens; identical to SEQ ID NO: 766315

SEQ ID NO: 766323 - protein, 105 aa, Homo sapiens; identical to SEQ ID NO: 766320

SEQ ID NO: 766324 - protein, 105 aa, Homo sapiens; identical to SEQ ID NO: 766320

SEQ ID NO: 766325 - protein, 164 aa, Homo sapiens
GHAPGGWSRAGRRAGSSAFRGGGSGGDGDMESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSGCAGLPGLPALQGWRGRLHPELR

SEQ ID NO: 766326 - protein, 253 aa, Homo sapiens; identical to SEQ ID NO: 766315

SEQ ID NO: 766327 - protein, 253 aa, Homo sapiens; identical to SEQ ID NO: 766315

SEQ ID NO: 766328 - protein, 240 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWVLLEKKLKVMAALTESAFTSTSFGFGDCPGLGEEAETSRTTGQGPRDAETAARDTHRQGNVRLADVPTSGQTTQAYDQKAR

SEQ ID NO: 766329 - protein, 169 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWRSSAKLLRVS

SEQ ID NO: 766330 - protein, 253 aa, Homo sapiens; identical to SEQ ID NO: 766315

SEQ ID NO: 766331 - protein, 230 aa, Homo sapiens
MSTHASGMSGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 766332 - protein, 253 aa, Homo sapiens; identical to SEQ ID NO: 766315

SEQ ID NO: 766333 - protein, 164 aa, Homo sapiens; identical to SEQ ID NO: 766325

SEQ ID NO: 766334 - protein, 305 aa, Homo sapiens
GHAPGGWSRAGRRAGSSAFRGGGSGGDGDMESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWWVGWPGAGSWVKGGGGWGPPATCTLLCSPCRVCWPPWPTSATRLAWTTSSRITLTPLRTPTLPTPPTQVHLWTTTNSHPSPRTRRPPRATSRPLCTERRLAWEGGQRGPSPLPWTFP

SEQ ID NO: 766335 - protein, 253 aa, Homo sapiens; identical to SEQ ID NO: 766315

SEQ ID NO: 766336 - protein, 253 aa, Homo sapiens; identical to SEQ ID NO: 766315

SEQ ID NO: 766337 - protein, 253 aa, Homo sapiens; identical to SEQ ID NO: 766315

SEQ ID NO: 766338 - protein, 253 aa, Homo sapiens; identical to SEQ ID NO: 766315

SEQ ID NO: 766339 - protein, 253 aa, Homo sapiens; identical to SEQ ID NO: 766315

SEQ ID NO: 766340 - protein, 164 aa, Homo sapiens; identical to SEQ ID NO: 766325

SEQ ID NO: 766341 - protein, 219 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQSVKDPVITT

SEQ ID NO: 766342 - protein, 170 aa, Homo sapiens
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWTPKQWTGSSKY

SEQ ID NO: 766343 - protein, 62 aa, Homo sapiens
MKFLVFAFILALMVSMIGADSSEEKFLRRIGRFGYGYGPYQPVPEQPLYPQPYQPQYQQYTF

SEQ ID NO: 766344 - protein, 81 aa, Homo sapiens
LPMALSPNLCTKKFLVFAFILALMVSMMELIHKKRNFCVELEDSVMGMALISQFQNNHYTHNHTNHNTNNIPFNIISNCRT

SEQ ID NO: 766345 - protein, 74 aa, Homo sapiens
SPGSAEAALQETMGCGGDFRVSEKGKQKDWEARVASPSHSADPAGPRPKLLEPELEEGHLHVLGAVFPVQNEIG

SEQ ID NO: 766346 - protein, 33 aa, Homo sapiens
LLGWDGFIQEQFLSNLPWARRRSPRDQDKIFVK

SEQ ID NO: 766347 - protein, 83 aa, Homo sapiens
NCPSPVLGHDHGEQVHCLPCVVHRGGSDSILKDDKKTGQDMSLRIQVMGVEPTGLQPHTAGLEAQTEYLLFYGLGGSRHRAPY

SEQ ID NO: 766348 - protein, 110 aa, Homo sapiens
GRCSLGLVPIYSGLRMAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 766349 - protein, 94 aa, Homo sapiens
GRCSLGLVPIYSGLRMAAARLCLSLLLLSTCVALLLQPLLGAQGAPLEPVYPGDNATPEQMAQYAADLRRYINMLTRPRPRPMCPGQDGAYRQI

SEQ ID NO: 766350 - protein, 108 aa, Homo sapiens
GAARQRVGFSQLRLDSALPGLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 766351 - protein, 120 aa, Homo sapiens
GRCSLGLVPIYSGLRMAAARLCLSLLLLSTCVALLLQPLLGAQGAPLEPVYPGDNATPEQMAQYAADLRRYINMLTRPSACPCCLFPPRYGKRHKEDTLAFSEWGSPHAAVPRELSPLDL

SEQ ID NO: 766352 - protein, 107 aa, Homo sapiens
MLWPASQVNDFGSARRKIEVRPKEELSACYGRAPGARRRGQPSPGQGSSHRSWICFSSSVCPVGPSPQAAVLDLTGEGAGGRGRTPSPGPTAALASPPLSPSVGASL

SEQ ID NO: 766353 - protein, 110 aa, Homo sapiens
RHERASTGSPARAAPCSPGSPGGRGGGGDHKMADLSLLQEDLQEDADGFGVDDYSSESDVIIIPSALDFVSQDEMLTPLGRLDKYAASENIFNRYVHILFVKVEVEGWFY

SEQ ID NO: 766354 - protein, 964 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766355 - protein, 981 aa, Homo sapiens
RHERASTGSPARAAPCSPGSPGGRGGGGDHKMADLSLLQEDLQEDADGFGVDDYSSESDVIIIPSALDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766356 - protein, 161 aa, Homo sapiens
MDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLILPQRDIFITSR

SEQ ID NO: 766357 - protein, 93 aa, Homo sapiens
RHERASTGSPARAAPCSPGSPGGRGGGGDHKMADLSLLQEDLQEDADGSLDFVSQDEMLTPLGRLDKYAASENIFNRYVHILFVKVEVEGWFY

SEQ ID NO: 766358 - protein, 103 aa, Homo sapiens
GGPSLPASQAPPYTGMHHTHPTCLLYVLVPHHMPGMCVFCSAHIQTCVYVHFTVHIHACSSLFLTAYYTGIHTCTPPHTYCAHIYHTTVPTRGCSCLGPRAQV

SEQ ID NO: 766359 - protein, 964 aa, Homo sapiens; identical to SEQ ID NO: 766354

SEQ ID NO: 766360 - protein, 964 aa, Homo sapiens
ARPGSGTRRRVPAGGRLRAPVRSARREGGSGGGYLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766361 - protein, 981 aa, Homo sapiens; identical to SEQ ID NO: 766355

SEQ ID NO: 766362 - protein, 911 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766363 - protein, 964 aa, Homo sapiens; identical to SEQ ID NO: 766354

SEQ ID NO: 766364 - protein, 1006 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVERCFVSDRTISLQQATQYSEQKIVDLRPCCGGPVTLSGLWSVRNMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766365 - protein, 988 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVERCFVSDRTISLQQATQYSEQKIVDLRPCCGGPVTLSGLWSVRNMDSTLHYIHSDSDLSNNSSFSPDEVSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766366 - protein, 367 aa, Homo sapiens
MDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766367 - protein, 964 aa, Homo sapiens; identical to SEQ ID NO: 766354

SEQ ID NO: 766368 - protein, 995 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVCIELLEILDQQTLRSSEWKLFLISPCSPSQVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766369 - protein, 949 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKAATRRLWSRPSWLFRWTVTAMSSILQASTLPVPKSPKMP

SEQ ID NO: 766370 - protein, 964 aa, Homo sapiens; identical to SEQ ID NO: 766354

SEQ ID NO: 766371 - protein, 116 aa, Homo sapiens
GLSYEAAVKSAEGLQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 766372 - protein, 93 aa, Homo sapiens
LSTGEDSKTLGHLLTLANDRVPNVRVLLAKTLRQTLLEKDYFLASASCHQEAVEQTIMALQMDRDSDVKYFASIHPASTKISEDAMSTASSTY

SEQ ID NO: 766373 - protein, 794 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLEYMPLQRGSS

SEQ ID NO: 766374 - protein, 602 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDLVLIRDCYEALRPRYL

SEQ ID NO: 766375 - protein, 355 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEDMKGPRD

SEQ ID NO: 766376 - protein, 551 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKGMEVNQVIYSEID

SEQ ID NO: 766377 - protein, 346 aa, Homo sapiens
RHERASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWSPSSFSVSGPEEADLESTLNARGDPK

SEQ ID NO: 766378 - protein, 567 aa, Homo sapiens
LVADILFLSGCPWPGFCNACVGRRWRCWESAEEMLSPVSRDASDALQGRKCLRPRSRRLPLPAAVRAHGPMAELTDSARGCVVFEDVFVYFSREEWELLDDAQRLLYHDVMLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 766379 - protein, 457 aa, Homo sapiens
MLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 766380 - protein, 457 aa, Homo sapiens; identical to SEQ ID NO: 766379

SEQ ID NO: 766381 - protein, 144 aa, Homo sapiens
MADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTSLSPCPSSLPFALASSIHVFQGLMHS

SEQ ID NO: 766382 - protein, 64 aa, Homo sapiens
MGPTTLSRERTCNKTVLSASCPGDGSYSSLCVLVRQHLPLLRGDLAPLPHICRTARGISKVDCR

SEQ ID NO: 766383 - protein, 105 aa, Homo sapiens
EPGPGVEREGNGTIDFPEFLTMMARKMKDTDSEEEIREAFRVFDKDGNGYISAAELRHVMTNLGEKLTREIKRTGIASCPGGLHFAVIICDKLFIIDLAISIDVS

SEQ ID NO: 766384 - protein, 83 aa, Homo sapiens
DPLCFPGEVMPALLRLTLGALHHCPEPTVELGTVMRSLGQNPTEAELQDMINEVDADGNGTIDFPEFLTMMARKMKDTYYVVP

SEQ ID NO: 766385 - protein, 98 aa, Homo sapiens
SPSFPHLPGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766386 - protein, 97 aa, Homo sapiens
AVAFPLSTASSSSSWLGSRPLAFHPPINPTHCPSAMFCCRPPPRSPHAVAQLLWKLVAPTARNRAASQKGVDACISSSGRPEAFCSLPSSSQPANPG

SEQ ID NO: 766387 - protein, 229 aa, Homo sapiens
KGEKTQTTELPTLTYLSQRRKSEARARFMLSAGGVWGQAGGRGKGSECGGADARRSWNCCSCCRRRRNLDPRAPDTPGLAMADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766388 - protein, 187 aa, Homo sapiens
RYLEIRVIPFARRSWNCCSCCRRRRNLDPRAPDTPGLAMADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766389 - protein, 149 aa, Homo sapiens [sequence omitted]

SEQ ID NO: 766390 - protein, 149 aa, Homo sapiens [sequence omitted]

SEQ ID NO: 766391 - protein, 149 aa, Homo sapiens [sequence omitted]

SEQ ID NO: 766392 - protein, 149 aa, Homo sapiens [sequence omitted]

SEQ ID NO: 766393 - protein, 113 aa, Homo sapiens
MRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766394 - protein, 149 aa, Homo sapiens [sequence omitted]

SEQ ID NO: 766395 - protein, 149 aa, Homo sapiens [sequence omitted]

SEQ ID NO: 766396 - protein, 149 aa, Homo sapiens [sequence omitted]

SEQ ID NO: 766397 - protein, 97 aa, Homo sapiens
SAGPGVERNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766398 - protein, 149 aa, Homo sapiens [sequence omitted]

SEQ ID NO: 766399 - protein, 149 aa, Homo sapiens [sequence omitted]

SEQ ID NO: 766400 - protein, 163 aa, Homo sapiens
KGEKTQTTELPTLTYLSQRRKSEARARFMLSAGGVWGQAGGRGKGSECGGADARRSWNCCSCCRRRRNLDPRAPDTPGLAMADQLTEEQIAEFKEAFSLFDKDGDGTITTKELGTVMRSLGQNPTEAELQDMINEVDADGWEWLHQRRRAASRNDEPGGEADR

SEQ ID NO: 766401 - protein, 149 aa, Homo sapiens [sequence omitted]

SEQ ID NO: 766402 - protein, 149 aa, Homo sapiens [sequence omitted]

SEQ ID NO: 766403 - protein, 68 aa, Homo sapiens
LDTRAVSAGDIDRDGQLNYEVCTDDDCKVKAPRAAGDARSLDLSLLARALSLQHSPAYPGSSKHQLID

SEQ ID NO: 766404 - protein, 149 aa, Homo sapiens [sequence omitted]

SEQ ID NO: 766405 - protein, 149 aa, Homo sapiens [sequence omitted]

SEQ ID NO: 766406 - protein, 149 aa, Homo sapiens [sequence omitted]

SEQ ID NO: 766407 - protein, 149 aa, Homo sapiens [sequence omitted]

SEQ ID NO: 766408 - protein, 149 aa, Homo sapiens [sequence omitted]

SEQ ID NO: 766409 - protein, 98 aa, Homo sapiens
MGSGHRMNKRQIQSFNPGPCSIYSVFDGNGYISAAELRHVMTNLGEKLTDEEVDEMIREADIDGDGQVNYEVAGWGLLIWPLCRLDLPAFLKRSRAVL

SEQ ID NO: 766410 - protein, 149 aa, Homo sapiens [sequence omitted]

SEQ ID NO: 766411 - protein, 149 aa, Homo sapiens [sequence omitted]

SEQ ID NO: 766412 - protein, 99 aa, Homo sapiens
FSEIPKTRLPRLYCKFNTSPSLNRETPAEYFPPLVHKKTGSTEKNPRKHLWPLSIYNPLFPPTQKKSPRNFFFFFFFFFFFSFPSMALKTFILFRTMLG

SEQ ID NO: 766413 - protein, 149 aa, Homo sapiens [sequence omitted]

SEQ ID NO: 766414 - protein, 120 aa, Homo sapiens
MADQLTEEQIAEFKEAFSLFDKDGDGTITTKELGTVMRSLGQNPTEAELQDMINEVDADGNGTIDFPEFLTMMARKMKDTDSEEEIREAFRVFDKMGMAPSATQRATRCASPSATQRATK

SEQ ID NO: 766415 - protein, 78 aa, Homo sapiens
RYLEIRVIPFARRSWNCCSCCRRRRNLDPRAPDTPGLAMADQLTEEQIAEFKEAFSLFDKDGDGTITTKEFVQMMTAK

SEQ ID NO: 766416 - protein, 78 aa, Homo sapiens; identical to SEQ ID NO: 766415

SEQ ID NO: 766417 - protein, 112 aa, Homo sapiens
GCSRGSQLRGELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766418 - protein, 33 aa, Homo sapiens
MWGWSLCNVLVLFFFLSPLWPCFIRCDLLSYHG

SEQ ID NO: 766419 - protein, 73 aa, Homo sapiens
MADQLTEEQIAEFKEAFSLFDKDGDGTITTKELGTVMRSLGQNPTEAELQDMINEVDADGTTIDFPEEENIRV

SEQ ID NO: 766420 - protein, 149 aa, Homo sapiens [sequence omitted]

SEQ ID NO: 766421 - protein, 149 aa, Homo sapiens [sequence omitted]

SEQ ID NO: 766422 - protein, 149 aa, Homo sapiens [sequence omitted]

SEQ ID NO: 766423 - protein, 149 aa, Homo sapiens [sequence omitted]

SEQ ID NO: 766424 - protein, 149 aa, Homo sapiens [sequence omitted]

SEQ ID NO: 766425 - protein, 149 aa, Homo sapiens [sequence omitted]

SEQ ID NO: 766426 - protein, 113 aa, Homo sapiens; identical to SEQ ID NO: 766393

SEQ ID NO: 766427 - protein, 104 aa, Homo sapiens
MGELQDTINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 766428 - protein, 80 aa, Homo sapiens
GTLLVFAGVFADSEEEIREAFRVFDKDGNGYISAAELRHVMTNLGEKLTDEEVDEMIREADIDGDGQVNYEEFVQMMTAK

SEQ ID NO: 766429 - protein, 77 aa, Homo sapiens
DASLQSILGPMEKRRDAFRVFDKDGNGYISAAELRHVMTNLGEKLTDEEVDEMIREADIDGDGQVNYEEFVQMMTAK

SEQ ID NO: 766430 - protein, 149 aa, Homo sapiens [sequence omitted]

SEQ ID NO: 766431 - protein, 107 aa, Homo sapiens
AGDHHTLEVYGRALQIKKKLAKKKKKNSRLDLSLFSHFGLFPLVCHLILGAGVAASPVPGPAGRDKRPSPRQKSMPFAVACNQPCDSTCRSQQPVGAGVPREAFQKD

SEQ ID NO: 766432 - protein, 167 aa, Homo sapiens
MADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEVAGWGLLIWPLCRLDLPAFLKRSRAVL

SEQ ID NO: 766433 - protein, 149 aa, Homo sapiens [sequence omitted]

SEQ ID NO: 766434 - protein, 149 aa, Homo sapiens [sequence omitted]

SEQ ID NO: 766435 - protein, 149 aa, Homo sapiens [sequence omitted]

SEQ ID NO: 766436 - protein, 149 aa, Homo sapiens [sequence omitted]

SEQ ID NO: 766437 - protein, 149 aa, Homo sapiens [sequence omitted]

SEQ ID NO: 766438 - protein, 149 aa, Homo sapiens [sequence omitted]

SEQ ID NO: 766439 - protein, 107 aa, Homo sapiens
MADQLTEEQIAEFKEAFSLFDKDGDGTITTKELGTVMRSLGQNPTEAELQDMINEVDADGNGTIDFPEFLTMMARKMKDTRPSQELRVRAGRREAVDIFGMFWFCFF

SEQ ID NO: 766440 - protein, 1265 aa, Homo sapiens [sequence omitted]

SEQ ID NO: 766441 - protein, 416 aa, Homo sapiens
MIGTFLILLPQVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 766442 - protein, 332 aa, Homo sapiens
MRHRSTDDLFSLCAENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 766443 - protein, 208 aa, Homo sapiens
MDVCIHELQVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 766444 - protein, 984 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLRDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGTKS

SEQ ID NO: 766445 - protein, 974 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLRDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFRKWLSKSNPEKGISTPGGKLWERTEREGKPKPKFGNNGVKPGGGKGKKGKTQGVTANSGAPPKFREGAPFIPEFVPF

SEQ ID NO: 766446 - protein, 117 aa, Homo sapiens
MFHSERKKREGQGCLQERKTFNHIKDPSVQESKVGMEEEKCRASWEDGISRGRALKTVNSKQENNMKYWEKNQSIAIELSDLVVYCKPTSKTKDNLGNIFPKNMPYNSNENLTSFRV

SEQ ID NO: 766447 - protein, 243 aa, Homo sapiens
MNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 766448 - protein, 1265 aa, Homo sapiens [sequence omitted]

SEQ ID NO: 766449 - protein, 1051 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLRDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTAGKGRLKVVPSLQGGGCSHSRPSHLGSAIPCGVQE

SEQ ID NO: 766450 - protein, 197 aa, Homo sapiens
RRTALVLTASAPEGRAPELAQFPSAVPAPHPPPVSLPSPTAAPGSAMGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYL

SEQ ID NO: 766451 - protein, 354 aa, Homo sapiens
RRTALVLTASAPEGRAPELAQFPSAVPAPHPPPVSLPSPTAAPGSAMGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 766452 - protein, 155 aa, Homo sapiens
RRTALVLTASAPEGRAPELAQFPSAVPAPHPPPVSLPSPTAAPGSAMGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVCVLCSGLSI

SEQ ID NO: 766453 - protein, 386 aa, Homo sapiens
RRTALVLTASAPEGRAPELAQFPSAVPAPHPPPVSLPSPTAAPGSAMGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 766454 - protein, 179 aa, Homo sapiens
MGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 766455 - protein, 153 aa, Homo sapiens
AAARGPRSASPRDSRAPAGCAARWVHEGAAPERRRLQLEPGARPSAGWLAGTSRTGGRVPCVDWQATPHLPRAHHFLSRWLQLTRRSLGRTWARVQEGAGGGGPVFCPPATGFRGWSPLQTPAGAWVSGRLLVCTSRQEQGSPTFHPGILICP

SEQ ID NO: 766456 - protein, 216 aa, Homo sapiens
MSIALKQVFNKDKTFRPKRKFEPGTQRFELHKRAQASLNSGVDLKAAVQLPSGEDQNDWVAVHVVDFFNRINLIYGTICEFCTERTCPVMSGGPKYEYRWQDDLKYKKPTALPAPQYMNLLMDWIEVQINNEEIFPTCVGVPFPKNFLQICKKILCRLFRVFVHVYIHHFDRVIVMGAEAHVNTCYKHFYYFVTEMNLIDRKELEPLKEMTSRMCH

SEQ ID NO: 766457 - protein, 216 aa, Homo sapiens; identical to SEQ ID NO: 766456

SEQ ID NO: 766458 - protein, 643 aa, Homo sapiens
PPGRPNPGGNGVVEVYSAAAPLAGSGTVEIQALGMQPYPPPSQVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 766459 - protein, 286 aa, Homo sapiens
PPGRPNPGGNGVVEVYSAAAPLAGSGTVEIQALGMQPYPPPSQVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVGGWWQQGPTPHQSKPFTGARVLNAA

SEQ ID NO: 766460 - protein, 393 aa, Homo sapiens
PPGRPNPGGNGVVEVYSAAAPLAGSGTVEIQALGMQPYPPPSQVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCFLVNATCGVICPPTAAGAGSSAKCARSSSGGSIISNCMLTSTRVRSPTNAQCASLRSTARTN

SEQ ID NO: 766461 - protein, 112 aa, Homo sapiens
PPWASQPWWERCGGGVQCCCAPGWEWNGGDPGTGDAALPTPRGEQRGQGGRGHWSWTSWPTRTHPEHQLCARHCAGDTMKTRPGPGLHGVYHITGEKDFNQSITPTDVRCKP

SEQ ID NO: 766462 - protein, 434 aa, Homo sapiens
PPGRPNPGGNGVVEVYSAAAPLAGSGTVEIQALGMQPYPPPSQVPNQCVEPPVYPTPTVYSPGKQGFKPKGPNPAAPMTSATGGTVATFDSPATLKTRRAKAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHV

SEQ ID NO: 766463 - protein, 81 aa, Homo sapiens
GKQGFKPKGPNPAAPMTSATGGTVATFDSPATLKTRRAKGARGLPEGGPPACHGHLSSTLANPQATWFWSSLLWLFKFGCM

SEQ ID NO: 766464 - protein, 360 aa, Homo sapiens
MAAPAAATAMGNAPAKKDTEQEESVNEFLAKARGDFLYRWGNPAQNTASSDQFERLRTLGMGSFGRVMLVRHQETGGHYAMKILNKQKVVKMKQVEHILNEKRILQAIDFPFLVKLQFSFKDNSYLYLVMEYVPGGEMFSRLQRVGRFSEPHACFYAAQVVLAVQYLHSLDLIHRDLKPENLLIDQQGYLQVTDFGFAKRVKGRTWTLCGTPEYLAPEIILSKGYNKAVDWWALGVLIYEMAVGFPPFYADQPIQIYEKIVSGRVRFPSKLSSDLKHLLRSLLQVDLTKRFGNLRNGVGDIKNHKWFATTSWIAIYEKKVEAPFIPKYTGPGDASNFDDYEEEELRISINEKCAKEFSEF

SEQ ID NO: 766465 - protein, 176 aa, Homo sapiens
MKRLINYKNMSSIWDRCKGTLNMETSVFPSHMGGKFSFSSARDLVLLKTWEEVLQLSSFPQRGKDHARTPEFSNRCSTPGDSQFWEVISDEHCIDSVGLTRGQHLAGDQLRHNGSRVTRLTTYRHSTLVHNAAPSINTIPTCVNLQPHMPNTYPKDIATLTPIAKHKAKDTTLTHI

SEQ ID NO: 766466 - protein, 185 aa, Homo sapiens
PFSSGRPRGQLRPPGSTGGAGGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766467 - protein, 156 aa, Homo sapiens
TEMMSARCEAWVLRGQLRPPGSTGGAGGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLG

SEQ ID NO: 766468 - protein, 185 aa, Homo sapiens
ALFSGRPRGQLRPPGSTGGAGGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766469 - protein, 185 aa, Homo sapiens; identical to SEQ ID NO: 766466

SEQ ID NO: 766470 - protein, 185 aa, Homo sapiens; identical to SEQ ID NO: 766466

SEQ ID NO: 766471 - protein, 185 aa, Homo sapiens; identical to SEQ ID NO: 766466

SEQ ID NO: 766472 - protein, 185 aa, Homo sapiens; identical to SEQ ID NO: 766466

SEQ ID NO: 766473 - protein, 185 aa, Homo sapiens; identical to SEQ ID NO: 766466

SEQ ID NO: 766474 - protein, 191 aa, Homo sapiens
TEMMSARCEAWVLRGQLRPPGSTGGAGGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766475 - protein, 185 aa, Homo sapiens; identical to SEQ ID NO: 766466

SEQ ID NO: 766476 - protein, 185 aa, Homo sapiens; identical to SEQ ID NO: 766466

SEQ ID NO: 766477 - protein, 171 aa, Homo sapiens
KEGRVCSKGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766478 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766479 - protein, 173 aa, Homo sapiens
GGRVGLAPRGRGRIGEWGRHQVRARRLGASAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766480 - protein, 185 aa, Homo sapiens; identical to SEQ ID NO: 766466

SEQ ID NO: 766481 - protein, 185 aa, Homo sapiens; identical to SEQ ID NO: 766466

SEQ ID NO: 766482 - protein, 143 aa, Homo sapiens
MNQLRSISTYQLMSRRARTYGERRYSGHAMVMRLPMWLPMMPVKLHYLSDVGDITEQTWLHGVDLDLSFLDRPIQMCCPSCNKMIVSQLSYNAGALTWLSCGSLCLLGCIAGCCFIPFCVDALQDVDHYCPNCRALLGTYKRL

SEQ ID NO: 766483 - protein, 115 aa, Homo sapiens
MPCRTWTITVPTAELSWAPTSVCRTQPDVEGAGCRRKSFPPLIQLHAWWRFCPGGLTSPGGPPSCLLLGGIRRKTNKSPNPRNCCLESCIGLAKTFPLSVSSTVSCLPETLSPAI

SEQ ID NO: 766484 - protein, 185 aa, Homo sapiens; identical to SEQ ID NO: 766466

SEQ ID NO: 766485 - protein, 105 aa, Homo sapiens
MSVPGPYQAATGPSSAPSAPPSYEETVAVNSYYPTPPAPMPGPTTGLVTGPDGKGMNPPSYYTQPAPIPNNNPSTCGLPGPPYHSLAFHPGNQESDRSDSAKESK

SEQ ID NO: 766486 - protein, 191 aa, Homo sapiens; identical to SEQ ID NO: 766474

SEQ ID NO: 766487 - protein, 185 aa, Homo sapiens; identical to SEQ ID NO: 766466

SEQ ID NO: 766488 - protein, 161 aa, Homo sapiens; identical to SEQ ID NO: 766478

SEQ ID NO: 766489 - protein, 161 aa, Homo sapiens; identical to SEQ ID NO: 766478

SEQ ID NO: 766490 - protein, 161 aa, Homo sapiens; identical to SEQ ID NO: 766478

SEQ ID NO: 766491 - protein, 191 aa, Homo sapiens
GGRVGLAPRGRGRIGEWGRHQVRARRLGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766492 - protein, 179 aa, Homo sapiens
QAVRPRVYGSTGGAGGGKMSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 766493 - protein, 161 aa, Homo sapiens; identical to SEQ ID NO: 766478

SEQ ID NO: 766494 - protein, 184 aa, Homo sapiens
MTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 766495 - protein, 282 aa, Homo sapiens
MSGADRSPNAGAAPDSAPGQAAVASAYQRFEPRAYLRNNYAPPRGDLCNPNGVGPWKLRCLAQTFATGEVSGRTLIDIGSGPTVYQLLSACSHFEDITMTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 766496 - protein, 320 aa, Homo sapiens
MSGADRSPNAGAAPDSAPGQAAVASAYQRFEPRAYLRNNYAPPRGDLCNPNGVGPWKLRCLAQTFATGEVSGRTLIDIGSGPTVYQLLSACSHFEDITMTDFLEVNRQELGRWLQEEPGAFNWSMYSQHACLIEGKGKDWGVRVGEEASHRVAGWGNRGLSVEQPVSPALCLLHRECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 766497 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 766498 - protein, 1050 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 766499 - protein, 1068 aa, Homo sapiens; identical to SEQ ID NO: 766497

SEQ ID NO: 766500 - protein, 267 aa, Homo sapiens
VLEDPGHFLHRTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 766501 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 766502 - protein, 55 aa, Homo sapiens
MLRLLLALNLFPSIQVTGNKILVKQSPMLVAYDNAVNLSYNEKSNGTIIHVKGEE

SEQ ID NO: 766503 - protein, 111 aa, Homo sapiens
VSLVTKENQVFVAGGLFYNEDNKEDPMSAYFLQFDHLDSEWLGMPPLPSPRCLFGLGEALNSIYVVGGREIKDGERCLDSVMCYDRLSFKWGESDPLPYVVYGHTVLSHMD

SEQ ID NO: 766504 - protein, 809 aa, Homo sapiens
MYEALPGPAPENEDGLVKVKEEDPTWEQVCNSQEGSSHTQEICRLRFRHFCYQEAHGPQEALAQLRELCHQWLRPEMHTKEQIMELLVLEQFLTILPKELQPCVKTYPLESGEEAVTVLENLETGSGDTGQQASVYIQGQDMHPMVAEYQGVSLECQSLQLLPGITTLKCEPPQRPQGNPQEVSGPVPHGSAHLQEKNPRDKAVVPVFNPVRSQTLVKTEEETAQAVAAEKWSHLSLTRRNLCGNSAQETVMSLSPMTEEIVTKDRLFKAKQETSEEMEQSGEASGKPNRECAPQIPCSTPIATERTVAHLNTLKDRHPGDLWARMHISSLEYAAGDITRKGRKKDKARVSELLQGLSFSGDSDVEKDNEPEIQPAQKKLKVSCFPEKSWTKRDIKPNFPSWSALDSGLLNLKSEKLNPVELFELFFDDETFNLIVNETNNYASQKNVSLEVTVQEMRCVFGVLLLSGFMRHPRREMYWEVSDTDQNLVRDAIRRDRFELIFSNLHFADNGHLDQKDKFTKLRPLIKQMNKNFLLYAPLEEYYCFDKSMCECFDSDQFLNGKPIRIGYKIWCGTTTQGYLVWFEPYQEESTMKVDEDPDLGLGGNLVMNFADVLLERGQYPYHLCFDSFFTSVKLLSALKKKGVRATGTIRENRTEKCPLMNVEHMKKMKRGYFDFRIEENNEIILCRWYGDGIISLCSNAVGIEPVNEVSCCDADNEEIPQISQPSIVKVYDECKEGVAKMDQIISKYRVRIRSKKWYSILVSYMIDVAMNNAWQLHRACNPGASLDPLDFRRFVAHFYLEHNAHLSD

SEQ ID NO: 766505 - protein, 809 aa, Homo sapiens; identical to SEQ ID NO: 766504

SEQ ID NO: 766506 - protein, 304 aa, Homo sapiens [sequence omitted]

SEQ ID NO: 766507 - protein, 56 aa, Homo sapiens
MVTRFLGPRYRELVKNWVPTAYTWGAVGAVGLVWATDWRLILDWVPYINGKFKKDN

SEQ ID NO: 766508 - protein, 91 aa, Homo sapiens
LDLKLIAFEVPKLPSLSLSLSPTSSPSEFGTKPAAMVTRFLGPRYRELVKNWVPTAYTWGAVGAVGLVWATDWRLILDWVPYINGKFKKDN

SEQ ID NO: 766509 - protein, 90 aa, Homo sapiens
MNEGKAHTAPRQHRCPTTRTNDEKQNTHTDEERSKQHQAHDIEKEAEEEENSDGTHTKERDKRKRPKPQGRKAEQHETQQHTAKQQEERS

SEQ ID NO: 766510 - protein, 70 aa, Homo sapiens
MTRNRTLTPMKSRSKQHQAHDIEKEAEEEENSDGTHTKERDKRKRPKPQGRKAEQHETQQHTAKQQEERS

SEQ ID NO: 766511 - protein, 134 aa, Homo sapiens
HPPSPPSPPPPPPPPPPPSPSPSPSPPPPPLPSPPPPPPLPPRPPPPPPPPPPPPPPTIGLVEAWLWPGQLDRVILRVRLRRDGDPVPGPTLPGAGQELGPDGLHMGRCGRRGAGVGHRLAADPGLGTLHQWQV

SEQ ID NO: 766512 - protein, 123 aa, Homo sapiens
MASLRRIINYTNPSQTALVPGGASSSHLSTCCIWSSPSLRMDKRKPTAQLQASYVSENSLDILMHVALNLTETCNKTFYYYLCSKTGWGAHEELSHLEEFNPRGGAPHFLQILLFGLGREKKH

SEQ ID NO: 766513 - protein, 134 aa, Homo sapiens; identical to SEQ ID NO: 766511

SEQ ID NO: 766514 - protein, 134 aa, Homo sapiens; identical to SEQ ID NO: 766511

SEQ ID NO: 766515 - protein, 134 aa, Homo sapiens; identical to SEQ ID NO: 766511

SEQ ID NO: 766516 - protein, 70 aa, Homo sapiens
ARYEAGVIGRGAAAMVTRFLGPRYRELVKNWVPTAYTWGAVGAVGLVWATDWRLILDWVPYINGKFKKDN

SEQ ID NO: 766517 - protein, 69 aa, Homo sapiens
VELRVYLDEGAAAMVTRFLGPRYRELVKNWVPTAYTWGAVGAVGLVWATDWRLILDWVPYINGKFKKDN

SEQ ID NO: 766518 - protein, 134 aa, Homo sapiens; identical to SEQ ID NO: 766511

SEQ ID NO: 766519 - protein, 70 aa, Homo sapiens; identical to SEQ ID NO: 766516

SEQ ID NO: 766520 - protein, 166 aa, Homo sapiens
HPPSPPSPPPPPPPPPPPSPSPSPSPPPPPLPSPPPPPPLPPRPPPPPPPPPPPPPPTIGLVEAWLWPGQLDRVILRVRLRRDGDPVPGPTLPGAGQELNAIKTTRAKIPALLVASASEPGSRSSCACPQLVSGHLAYTWRVSGSRRPTHGALWAPWGWCGPPIGG

SEQ ID NO: 766521 - protein, 104 aa, Homo sapiens
RTHFLTASCPRVILRTTAIYVLVLFALYFLLSYMDTEQYEEAVRDYEKVYQTEKTKEHKQLLKNAQLELKKSKRKDYYKIYEWKDFLTASCLPGVFREPLSVPL

SEQ ID NO: 766522 - protein, 450 aa, Homo sapiens
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGSSPRSMPRGTAGVPRAGTLSPRTSLHSCTNWGRTQTGAPEGAGGRPGPGLPPAPPPTGCPQHSPLKPGLGPSSLTLLIHLPRPQPFPKCLADHTTLGTWFAGQRGVLKQLAVMATGGCADLLSGRHLPGALRVAGANPNQQATNTELAPHRTWEVSVGPEACPVCSGHHGAFLLSWAEGRVRPPGGGAGRLAHVWGSRSHGHTCAHMPTGQLCAKGNLGKTKAVRGSGRLPG

SEQ ID NO: 766523 - protein, 450 aa, Homo sapiens; identical to SEQ ID NO: 766522

SEQ ID NO: 766524 - protein, 450 aa, Homo sapiens; identical to SEQ ID NO: 766522

SEQ ID NO: 766525 - protein, 130 aa, Homo sapiens
MRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYM

SEQ ID NO: 766526 - protein, 367 aa, Homo sapiens
MEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766527 - protein, 69 aa, Homo sapiens
STMYVIKGPWGTSKNQRTSSQSLSGKGDEFGPHRYIANLGHGLYPDMDPEHVGAFVDAVHKHSRLLRQN

SEQ ID NO: 766528 - protein, 101 aa, Homo sapiens
LYNSSSDPIIVIESKADWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766529 - protein, 391 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766530 - protein, 391 aa, Homo sapiens; identical to SEQ ID NO: 766529

SEQ ID NO: 766531 - protein, 391 aa, Homo sapiens; identical to SEQ ID NO: 766529

SEQ ID NO: 766532 - protein, 391 aa, Homo sapiens; identical to SEQ ID NO: 766529

SEQ ID NO: 766533 - protein, 370 aa, Homo sapiens
MTPCKHSLGHTCYSPRGSSYRQLTMEANGLGPQGFPELKNDTFLRAAWGEETDYTPVWCMRQAGRYLPEFRETRAAQDFFSTCRSPEACCELTLQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766534 - protein, 268 aa, Homo sapiens [sequence omitted]

SEQ ID NO: 766535 - protein, 325 aa, Homo sapiens
MTHSCEQPGERKQTTLPFGACARQAVTYQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766536 - protein, 268 aa, Homo sapiens [sequence omitted]

SEQ ID NO: 766537 - protein, 268 aa, Homo sapiens [sequence omitted]

SEQ ID NO: 766538 - protein, 268 aa, Homo sapiens [sequence omitted]

SEQ ID NO: 766539 - protein, 365 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEVTARAPLCVCYCALLWLWLYYSVCTCF

SEQ ID NO: 766540 - protein, 316 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKAR

SEQ ID NO: 766541 - protein, 433 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPVPQYCGTGQGLGARGDHSGRSGVDKRKGQSGFCDTIFLSFSEWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766542 - protein, 316 aa, Homo sapiens; identical to SEQ ID NO: 766540

SEQ ID NO: 766543 - protein, 322 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARRRSGSW

SEQ ID NO: 766544 - protein, 288 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMVRIGMG

SEQ ID NO: 766545 - protein, 206 aa, Homo sapiens [sequence omitted]

SEQ ID NO: 766546 - protein, 250 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQVSPERERNRLGFGL

SEQ ID NO: 766547 - protein, 288 aa, Homo sapiens; identical to SEQ ID NO: 766544

SEQ ID NO: 766548 - protein, 288 aa, Homo sapiens; identical to SEQ ID NO: 766544

SEQ ID NO: 766549 - protein, 185 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPVPQ

SEQ ID NO: 766550 - protein, 288 aa, Homo sapiens; identical to SEQ ID NO: 766544

SEQ ID NO: 766551 - protein, 337 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766552 - protein, 131 aa, Homo sapiens
MEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQVSPERERNRLGFGL

SEQ ID NO: 766553 - protein, 159 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQMFSPPPGTGHGGDHGTWQRTQLPRAIKRRAGPRTPTGSRSGSL

SEQ ID NO: 766554 - protein, 344 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALRGQRCPRSAGVNMHSSHRGEKAQLHPVKLAQDQHASPRLALLLERSLASGTALRPATTIDLRASRSPLPATCLEATTSTSWAAGTE

SEQ ID NO: 766555 - protein, 250 aa, Homo sapiens; identical to SEQ ID NO: 766546

SEQ ID NO: 766556 - protein, 220 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766557 - protein, 186 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPPSWL

SEQ ID NO: 766558 - protein, 212 aa, Homo sapiens
MTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766559 - protein, 235 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPEEIGQLVKQMLDDFGPHRYIANLGHGLYPDMDPEHVGAFVDAVHKHSRLLRQN

SEQ ID NO: 766560 - protein, 119 aa, Homo sapiens
MRQAGRYLPEFRETRAAQDFFSTCRSPEACCELTLQVRGPQKRERFMPSVCHLATCLLFPTATASLPSGCCHHFLRHPCCTPGTGHGGDHGTWQRTQLPRAIKRRAGPRTPTGSRSGSL

SEQ ID NO: 766561 - protein, 222 aa, Homo sapiens
MVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 766562 - protein, 156 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQVRGPQKRERFMPSVCHLATCLLFPTATASLPSGCCHHFLRHPCCTPGTHSNLILEYNPRTP

SEQ ID NO: 766563 - protein, 197 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPGDIAGQPGPLCLVCI

SEQ ID NO: 766564 - protein, 189 aa, Homo sapiens
LTPCKHSLGHTCYSPRGSSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYM

SEQ ID NO: 766565 - protein, 80 aa, Homo sapiens
LTPCKHSLGHTCYSPRGSSYRQLTMEANGLGPQGFPELKNDTFLRAAWGEETDYTPVWCMRQAGRYLPGAPVMWDRWALS

SEQ ID NO: 766566 - protein, 555 aa, Homo sapiens
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 766567 - protein, 270 aa, Homo sapiens
RLQPNPGPSSTMWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQASPVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 766568 - protein, 179 aa, Homo sapiens
RLQPNPGPSSTMWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVFPSESPRYVALCQHQHYLGHIL

SEQ ID NO: 766569 - protein, 173 aa, Homo sapiens
RLQPNPGPSSTMWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQGA

SEQ ID NO: 766570 - protein, 180 aa, Homo sapiens
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKLRKIFTFKSKAHRHS

SEQ ID NO: 766571 - protein, 166 aa, Homo sapiens [sequence omitted]

SEQ ID NO: 766572 - protein, 162 aa, Homo sapiens
LHRAPARDHGSEVARHLLFQSHMATKTTSMSSQGSDDEQRKRENIRSLTVSGHVGFENLPDQLVNRSIQQGFCFNILCGGNWNGKSTLIDTLFNTNLEDYESSHFCPNVKLKVQTYELQESNVRLKLTIVNTVGFGDQINKEESYQPIVDYIDAQFEACLQE

SEQ ID NO: 766573 - protein, 184 aa, Homo sapiens
MGAGWGGMEACPAGGAPRTRSCHSCPGLCGGLWPRTARVCLGRGEARRRPPLPVGPRPPGGRLPDGVPPASQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 766574 - protein, 481 aa, Homo sapiens
IVLPRARPPMAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 766575 - protein, 478 aa, Homo sapiens
IVLPRARPPMAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 766576 - protein, 504 aa, Homo sapiens
IVLPRARPPMAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 766577 - protein, 125 aa, Homo sapiens [sequence omitted]

SEQ ID NO: 766578 - protein, 336 aa, Homo sapiens
VPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGPTSTTSS

SEQ ID NO: 766579 - protein, 215 aa, Homo sapiens
VPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPVSFLLSVPSCHPTFLSIFSHGK

SEQ ID NO: 766580 - protein, 105 aa, Homo sapiens
YFLQYWSLVQIHQLLLLPTRCQHTRGLCSVGVSAPRLDLPLMVCICIYALERHWGTGDMRHETAQVSWQRGKESRVVSLTFSLSACQASIPTPHQPSSLSQDLFL

SEQ ID NO: 766581 - protein, 107 aa, Homo sapiens
QTQSVETTRVSQINTLNTLTPVTTSTVLSSPSGFNPSGTVSQETFPSGETTISSPSSVSNTFLVTSKVFRMPISRDSTLGNTEETSLSVSGSLSQGTTWENLKFKLL

SEQ ID NO: 766582 - protein, 215 aa, Homo sapiens; identical to SEQ ID NO: 766579

SEQ ID NO: 766583 - protein, 57 aa, Homo sapiens
ELTESVMDVVRKEAESCDCLQGFQLTHSLGGGTGSGMGTLLISKIREEYPDRIINTF

SEQ ID NO: 766584 - protein, 149 aa, Homo sapiens
GAIVAPAGCAGPRTLREARVRGHEFEANLVHMGRKKKTQQQHKTTLVGGGRGPRGRKVSSTQSPLGPGAQEGNGAQWATQVCQAGDTGDRRTGAWTLTQKKGARGKPGLFQGNTPRGGAKRGTERGIYNPQGGPDASAIIKIKPRRRGV

SEQ ID NO: 766585 - protein, 73 aa, Homo sapiens
GAIVAPAGCAGPRTLREARVRGHEFEANLVHMGRKKKKKNLVPNSAEQRGYGLQGSITNNYSGTQQVQTTHKQ

SEQ ID NO: 766586 - protein, 98 aa, Homo sapiens
MSRVWGGGGPSVGVSVDIGAITRGSKRENPGQGAKAAGGSLSPLKKRAGGEKPGGGSCGKNFPGVGVHEGGKLRGDLFTTGGFKGEGLRFKIRARVGG

SEQ ID NO: 766587 - protein, 219 aa, Homo sapiens
MKGHGELQGHERRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMRTTTFNKHRKAPHWTRLTYPGATSRQTTSEDTLSSPGPTTRHRHAPPTNDISA

SEQ ID NO: 766588 - protein, 803 aa, Homo sapiens
MTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHASHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 766589 - protein, 803 aa, Homo sapiens; identical to SEQ ID NO: 766588

SEQ ID NO: 766590 - protein, 804 aa, Homo sapiens
MGRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 766591 - protein, 808 aa, Homo sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHASHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 766592 - protein, 75 aa, Homo sapiens [sequence omitted]

SEQ ID NO: 766593 - protein, 219 aa, Homo sapiens
MASVTDGKTGVKDASDQNFDYMFKLLIIGNSSVGKTSFLFRYADDTFTPAFVSTVGIDFKVKTVYRHEKRVKLQIWDTAGQERYRTITTAYYRGAMGFILMYDITNEESFNAVQDWATQIKTYSWDNAQVILVGNKCDMEEERVVPTEKGQLLAEQLGFDFFEASAKENISVRQAFERLVDAICDKMSDSLDTDPSMLGSSKNTRLSDTPPLLQQNCSC

SEQ ID NO: 766594 - protein, 219 aa, Homo sapiens; identical to SEQ ID NO: 766593

SEQ ID NO: 766595 - protein, 110 aa, Homo sapiens
SLVYANKGSMTQRRSVKRAYKNGGDAGAWSAERSGLVVRWAVLVFRSSTAALPRAAEAARRSEKWPKTSALGERKWPEPSRLLVSPPVGKPPANSWPRKPPGKALPLPAG

SEQ ID NO: 766596 - protein, 84 aa, Homo sapiens
AEVILRIPVRRRLSKKSAPSTGGVKKPHRYRPGTVALREIRRYQKSTELLIRKLPFQRLVREIAQDFKTDLRFQSAAIRCAAGG

SEQ ID NO: 766597 - protein, 40 aa, Homo sapiens
MPRAGFYNTWDLENPWGYPTLNPFDLQRVPTLMGNGNLTV

SEQ ID NO: 766598 - protein, 114 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIRCAAGKTKAWSRGRAGRFPLPEWD

SEQ ID NO: 766599 - protein, 107 aa, Homo sapiens
MARTKQTARKSTGGKAPRKQLATKAARKSAPSTGGVKKPHRYRPGTVALREIRRYQKSTELLIRKLPFQRLVREIAQDFKTDLRFPLYRSVPGGLFEDTRDTSCPKT

SEQ ID NO: 766600 - protein, 92 aa, Homo sapiens
KLLTMYGTCAGLCVPATAGAPAQHGFQLATSGRWGRQAGPGKASCCQEAATGKAAACPCLLQGNSGLRSQRPGQRGVSIPKPPLLNPAQFCK

SEQ ID NO: 766601 - protein, 2205 aa, Homo sapiens
PTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSIPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 766602 - protein, 1440 aa, Homo sapiens
LRAVLEDPSTVRLHCPEQTTTPVATMSTIHPSSTPETTHTSTVLTTKATTTRATSSTSTPSSTPGTTWILTELTTAATTTAATGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 766603 - protein, 967 aa, Homo sapiens
NRARYPAIYSMATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 766604 - protein, 1145 aa, Homo sapiens
PTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSIPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATAYFYTNPVIVGC

SEQ ID NO: 766605 - protein, 133 aa, Homo sapiens
PFSGLKKGVIVNPVFVVVASLIVYPVPGVENGVAVDPVNAVVVAVVVSSVRIQVVPGVKKGMAVELVPGHHTHSHQFQSHFLLQSKDCNHPSSADKHSHQIHSYQRYTHPLLHPWDHRDPSGFHHYTIFKAFW

SEQ ID NO: 766606 - protein, 1506 aa, Homo sapiens
PTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 766607 - protein, 1139 aa, Homo sapiens
FELRTRTECNGSTVTPSSIPGTTHTARVLTTTTTTVATGSMATPSSSTQTSGTPPSLTTTATTITATGSTTNPSSTPGTTPIPPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 766608 - protein, 2051 aa, Homo sapiens
PTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSIPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQLLCDLMLSQVFAECHTLLPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQVTAEACGG

SEQ ID NO: 766609 - protein, 1919 aa, Homo sapiens
MPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDRAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAVICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQSIITGNFLMGPLNLTLIASKKYSIPQVSAAAVTDSEGESSKSYLDKQRILTVDSFAASSTVPHCEQSCREKELLKTEQCSSEGRFYSCKRKEKMNIHIVKPGENNNKFSISTMLPPVSECINKNISNSSKKRPSTVDKCEDSQEQQQDTTVSSCKKLKVDMKDVTKINREKATFKHPRTTGSHPKSENKIVPSSCDSLKRNHLTPKKVEMQRSLPGSLLPLENPKDTCASKSESKIDLTVSSDHFSGQQENLNSMKKRNVNFSAAETKSDKKDCAAFAICDQKSVHGTFSPDHGTLLQKFLKNSPDPTQKSCLSDINPETDVSLVPDASVLSKPIFCFVKDVHPDLEMNDTVFELQDNDIVNSSIKNSSCMTSPEPICIQNKIPTLQINKLQPTETESEDKYMKDTLNPNTVHTFGASGHITLNVNQGAEYSLSEQQNDKNSKVLMQNAATYWNELPQSACNPTYNSSEHLFGTSYPYSAWCVYQYSNSNGNAITQTYQGITSYEVQPSPSGLLTTVASTAQGTHSNLLYSQYFTYFAGEPQANGFVPVNGYFQSQIPASNFRQPIFSQYASHQPLPQATYPYLPNRFVPPEVPWVYAPWHQESFHPGH

SEQ ID NO: 766610 - protein, 2789 aa, Homo sapiens
MPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDRAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAVICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQSIITGNFLMGPLNLTLIASKKYSIPQVSAAAVTDSEGESSKSYLDKQRILTVDSFAASSTVPHCEQSCREKELLKTEQCSSGNCLHTDGNETNVTENYELDVASGTEEDKSYGENIVELSSSDSSLLLRDNVKGSSSETCIVKKDTEDRITWKVKQAEKAKDSVYKRSMTEGSTVNTEYKNQKNQISEESCLNEKIITTNLIDSHLSTKNTTTESVPLKNTVSNPLNKREKKGEIKVSKDSQSDLTLHSEIAYISKPGILGVNHTPILPAHSETCKVPTLLKKPASYVSDFKEKHCSANHTALIANLSQILQRADEASSLQILQEETKVCLNILPLFVEAFERKQECSVEQILISRELLVDQNLWNNCKHTLKPCAVDTLVELQMMMETIQFIENKKRHLEGEPTLRSLLWYDETLYAELLGKPRGFQQQSNFYPGFQGRLKYNAFCELQTYHDQLVELLEETKREKNSYYVFLKYKRQVNECEAIMEHCSDCFDFSLSVPFTCGVNFGDSLEDLEILRKSTLKLINVCGDSPKVHSYPGKQDHLWIIIEMISSKVNFIKNNEAVRVKISLYGLEHIFFDAAKNLVWKERTQSFSKKYSQKKDEERLLRVNKCAFSKLQKIYDTLSKDLNNEPISPIGLEEDTIIASRKSDHPINEATISIENSKFNSNLLAHPDICCISEILDQAEFADLKKLQDLTLRCTDHLEILKKYFQMLQDNNMDNIFITEENVLDVVINHSHEAIILKPEAIEMYIEIVMVSETIHFLKNSIAKKLDKQRFRGMLWFDLSLLPELVQCQEKMASFSFLKDNSTDVCLWKVIETAVSELKKDLDIICKYNEAVNCSYAIHLLSRELQELSEIKKLLKKSKYFISTYIDFVPYIASINYGSTVTELEYNYNQFSTLLKNVMSAPRKDLGKMAHIRKVMKTIEHMKMICTKNAELTISFFLCQMLYNRRKILQLKRKEKMNIHIVKPGENNNKFSISTMLPPVSECINKNISNSSKKRPSTVDKCEDSQEQQQDTTVSSCKKLKVDMKDVTKINREKATFKHPRTTGSHPKSENKIVPSSCDSLKRNHLTPKKVEMQRSLPGSLLPLENPKDTCASKSESKIDLTVSSDHFSGQQENLNSMKKRNVNFSAAETKSDKKDCAAFAICDQKSVHGTFSPDHGTLLQKFLKNSPDPTQKSCLSDINPETDVSLVPDASVLSKPIFCFVKDVHPDLEMNDTVFELQDNDIVNSSIKNSSCMTSPEPICIQNKIPTLQINKLQPTETESEDKYMKDTLNPNTVHTFGASGHITLNVNQGAEYSLSEQQNDKNSKVLMQNAATYWNELPQSACNPTYNSSEHLFGTSYPYSAWCVYQYSNSNGNAITQTYQGITSYEVQPSPSGLLTTVASTAQGTHSNLLYSQYFTYFAGEPQANGFVPVNGYFQSQIPASNFRQPIFSQYASHQPLPQATYPYLPNRFVPPEVPWVYAPWHQESFHPGH

SEQ ID NO: 766611 - protein, 89 aa, Homo sapiens
MTVLGPLIHGSSDTLGQLFWVSGRCEGVPPPGRVQATLSSPAERLPVCRLSVSLFPFPSSLLCSYLSFLLDFLLCSNVMIMDELERGSK

SEQ ID NO: 766612 - protein, 233 aa, Homo sapiens
MAGVRSLRCSRGCAGGCECGDKGKCSDSSLLGKRLSEDSSRHQLLQKWASMWSSMSEDASVADMERAQLEEEAAAAEERPLVFLCSGCRRPLGDSLSWVASQEDTNCILLRCVSCNVSVDKEQKLSKREKENGCVLETLCCAGCSLNLGYVYRCTPKNLDYKRDLFCLSVEAIESYVLGSSEKQIVSEDKELFNLESRVEIEKSLTQMEDVLKALQMKLWEAESKLSFATCKS

SEQ ID NO: 766613 - protein, 233 aa, Homo sapiens; identical to SEQ ID NO: 766612

SEQ ID NO: 766614 - protein, 179 aa, Homo sapiens
MAGVRSLRCSRGCAGGCECGDKGKCSDSSLLGKRLSEDSSRHQLLQKWASMWSSMSEDASVADMERAQLEEEAAAAEERPLVFLCSGCRRPLGDSLSWVASQEDTNCILLRCVSCNVSVDKEQKLSKREKENGCVLETLCCAGCSLNLGYVYRCTPKNLDYKRDLFCLSVEAIERWKMS

SEQ ID NO: 766615 - protein, 233 aa, Homo sapiens; identical to SEQ ID NO: 766612

SEQ ID NO: 766616 - protein, 193 aa, Homo sapiens
FQAGHWGTVGGTQKMLPLLIICLLPAIEGKNCLRCWPELSALIDYDLQILWVTPGPPTELSQNRDHLEEETAKFFTQVHQAIKTLRDDKTVLLEEIYTHKNLFTERLNKISDGLKEKDIQSTLKVTSCADCRTHFLSCNDPTFCPARNRRTSLWAVSLSSALLLAIAGGCFFYWQRKKEAVKQEQGSPHVFQK

SEQ ID NO: 766617 - protein, 150 aa, Homo sapiens
FQAGHWGTVGGTQKMLPLLIICLLPAIEGKNCLRCWPELSALIDYDLQILWVTPGPPTELSQSIHSLFLEDRDHLEEETAKFFTQVHQAIKTLRDDKTVLLEEIYTHKNLFTERLNKISDGLKEKARNRRTSLWAVSLSSALLLAIAGGG

SEQ ID NO: 766618 - protein, 154 aa, Homo sapiens
FQAGHWGTVGGTQKMLPLLIICLLPAIEGKNCLRCWPELSALIDYDLQILWVTPGPPTELSQSIHSLFLEDNNFLKPWYLDRDHLEEETAKFFTQVHQAIKTLRDGEEAKSPRALGLGLTKAHPPRHSQRPMWPWVGGLVKVGDECSLSPCALW

SEQ ID NO: 766619 - protein, 309 aa, Homo sapiens
FQAGHWGTVGGTQKMLPLLIICLLPAIEGKNCLRCWPELSALIDYDLQILWVTPGPPTELSQSIHSLFLEDRDHLEEETAKFFTQVHQAIKTLRDDKTVLLEEIYTHKNLFTERLNKISDGLKEKGKGWGRSLHTAQPSTPAKTQGMQIFTLQPPRSSPGAPPLSMNAFPAPSPTCTPEPLGSVCLPSTSVSLPSHPPWQPAMSPVVSMHGDWAWGRDERHLAPPSPCPSPPIDIQSTLKVTSCADCRTHFLSCNDPTFCPARNRRTSLWAVSLSSALLLAIAGGCFFYWQRKKEAVKQEQGSPHVFQK

SEQ ID NO: 766620 - protein, 188 aa, Homo sapiens
FQAGHWGTVGGTQKMLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKARNRRTSLWAVSLSSALLLAIAGGRNRAARMSSRSEQRPQLPPSQSSLISGSR

SEQ ID NO: 766621 - protein, 150 aa, Homo sapiens
FQAGHWGTVGGTQKMLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKAPQFLYLLTLPGSLQ

SEQ ID NO: 766622 - protein, 759 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766623 - protein, 599 aa, Homo sapiens
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766624 - protein, 457 aa, Homo sapiens
MEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766625 - protein, 101 aa, Homo sapiens
MYRLVEPHSSPGSHLLELQKEDILQYLMECLWKVFFRKAKYGHFTLMTDPSNTRKNTAYLLKNIRTLTTMAQVFSGPVRNQVLSDKSFIPNNDGVWNFLVY

SEQ ID NO: 766626 - protein, 759 aa, Homo sapiens; identical to SEQ ID NO: 766622

SEQ ID NO: 766627 - protein, 561 aa, Homo sapiens
MMVDKGEEGKTIILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766628 - protein, 457 aa, Homo sapiens; identical to SEQ ID NO: 766624

SEQ ID NO: 766629 - protein, 759 aa, Homo sapiens; identical to SEQ ID NO: 766622

SEQ ID NO: 766630 - protein, 405 aa, Homo sapiens
RPRGSQFRLHSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766631 - protein, 360 aa, Homo sapiens [sequence omitted]

SEQ ID NO: 766632 - protein, 252 aa, Homo sapiens
MEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766633 - protein, 261 aa, Homo sapiens
VVSRGSLRILGARASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 766634 - protein, 86 aa, Homo sapiens
SSSVPNLENGADSDEDDNSFLKQQSPQEPKSLNWSSFVDNTFAEEFTTQNQKSQDVELWEGEVVKELSVEEQIKRNRYYDEDEDEE

SEQ ID NO: 766635 - protein, 445 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLRSQPKTSHLSITGTLEGVFGF

SEQ ID NO: 766636 - protein, 372 aa, Homo sapiens [sequence omitted]

SEQ ID NO: 766637 - protein, 307 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTVCVLHHSFIHSFHHPADGH

SEQ ID NO: 766638 - protein, 117 aa, Homo sapiens
AAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTVDTQW

SEQ ID NO: 766639 - protein, 173 aa, Homo sapiens
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIP

SEQ ID NO: 766640 - protein, 293 aa, Homo sapiens
AAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIP

SEQ ID NO: 766641 - protein, 173 aa, Homo sapiens; identical to SEQ ID NO: 766639

SEQ ID NO: 766642 - protein, 318 aa, Homo sapiens
MQAGPPPPPPPPPSAPPTPSPALRAAAQGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766643 - protein, 519 aa, Homo sapiens
MQAGPPPPPPPPPSAPPTPSPALRAAAQGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRTIGVTQIHPPSASASVLTRRATGTSAHARYTSRASQAGRKTLFGRKLPCGQVLSPDTSLPGIEENRQQNTMNSTTTATASPVMTMPNTPPERGGWRGRSRGARAGQDAREGKRGERRAEAAGKRRRRARARADVTARSGGGETRAQDASRAHRTGTDARGGAAAAPPAAQPPKLQARRARAETSPPPSATAQAQQEQTRAEDEQQEKERDSATGRRKTQTGAAQTRTPRRTREKRRRTQITRAPSPTRPTSKTTQRERRAHETHGQATTADANAHEGKNGGSTYTNKTAERGRPKRGGRTQREAAARKRRGHHDAREHEADGRADH

SEQ ID NO: 766644 - protein, 67 aa, Homo sapiens
ITVLGTRLVFAGAESGPQRALSSPTAAAGLVTITPREEPQLPQPAPVTITATMSSEAETHAGRPRKE

SEQ ID NO: 766645 - protein, 374 aa, Homo sapiens
RVCDGVPSPPTGLVRSGPHAVVRVTPTQLTFRVCSEGAAHRLSRQERLPLPSRAIRPRPAHTPILGPAPRACPGAPRASDSPTCAAAAATAWPRTRAVERKGCQVAAAAGVRGTGCPSRADLEKDSWNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766646 - protein, 318 aa, Homo sapiens; identical to SEQ ID NO: 766642

SEQ ID NO: 766647 - protein, 318 aa, Homo sapiens; identical to SEQ ID NO: 766642

SEQ ID NO: 766648 - protein, 318 aa, Homo sapiens; identical to SEQ ID NO: 766642

SEQ ID NO: 766649 - protein, 247 aa, Homo sapiens
MQAGPPPPPPPPPSAPPTPSPALRAAAQGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRYGPRKH

SEQ ID NO: 766650 - protein, 105 aa, Homo sapiens
MSSEAETHAGRPAAPPAAPALSAADTKPGTTGSGAGERWPGRPHIGGACRRGQEGHRNEGFGNSKMCQDEVGEVSLIIHDKRARVDADMALKTTAGVQASTWLGW

SEQ ID NO: 766651 - protein, 320 aa, Homo sapiens
MSSEAETHAGRPPPPSAPPTPSPALRAAAQGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766652 - protein, 319 aa, Homo sapiens
MSSEAETHAGRPGLLSVTTCTTGWCERSGACGPVRPYFGGACRFGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766653 - protein, 408 aa, Homo sapiens
RVCDGVPSPPTGLVRSGPHAVVRVTPTQLTFRVCSEGAAHRLSRQERLPLPSRAIRPRPAHTPILGPAPRACPGAPRASDSPTCAAAAATAWPRTRAVERKGCQVAAAAGVRGTGCPSRADLEKDSWYIVACFALFSFPATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766654 - protein, 298 aa, Homo sapiens
MCLAFQAHSRLDCRHSELNDSQGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766655 - protein, 189 aa, Homo sapiens
MVSSTGMTPRKMYLYTRVRRQQMLQVLVVFQFKAVNMQQTVTIIDAIHVVGVLHAITSKTYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766656 - protein, 318 aa, Homo sapiens; identical to SEQ ID NO: 766642

SEQ ID NO: 766657 - protein, 318 aa, Homo sapiens; identical to SEQ ID NO: 766642

SEQ ID NO: 766658 - protein, 288 aa, Homo sapiens
MQAGPPPPPPPPPSAPPTPSPALRAAAQGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEKTQNTHKGAARGLKIEQTSNPDGGLPHLNGTRE

SEQ ID NO: 766659 - protein, 519 aa, Homo sapiens; identical to SEQ ID NO: 766643

SEQ ID NO: 766660 - protein, 115 aa, Homo sapiens
MVSSTGMTPRKMYLYTRVRRQQMLQVLVVFQFKAVNMQQTVTIIDAIHVVGVLHAITSKITRIVRVGKRTRDRRVLPKARPNNAGPTAGEGSHLTTCGDPMGVDHSIPTLLCREK

SEQ ID NO: 766661 - protein, 320 aa, Homo sapiens; identical to SEQ ID NO: 766651

SEQ ID NO: 766662 - protein, 290 aa, Homo sapiens
MSSEAETHAGRPPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766663 - protein, 146 aa, Homo sapiens
MSSEAETHAGRPGLLRDHVHYGLVLNAVERVAPCGLTLAGPAVRGQEGHRNERFWTHVQWFNVRNRIWFHQQEMTPMGKMYLYNPVCAINRQKLHPPRKVYPFAGVTDDSDADLVARFGLHRFGTGTKNRRCREAPSKKLFHKGSG

SEQ ID NO: 766664 - protein, 270 aa, Homo sapiens
MTTKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 766665 - protein, 56 aa, Homo sapiens
MAVRVLSVSDIPHTTPPGTPGADSADGHAAISKWYGSFIWAAWGNANPPKYGSFLL

SEQ ID NO: 766666 - protein, 359 aa, Homo sapiens
MAGHLASDFAFSPPPGGGGDGPGGPEPGWVDPRTWLSFQGPPGGPGIGPGFGPGSEEWGIPPCPPPYEFCGGMAYCGPQTGVGLVPQDGLETSQPEGEAGVGVESNSDGASPEPCTVPSGAVKLEKEKLEQNPEESQDIKALQKELEQFAKLLKQKRITLGYTQAVWLTLGVLFGKVFSQTTICRFEALQLSFKNMCELRPLLQKWVEEADNNENLQEICKAETLVQAGKRKRTSIENQVRGNLENLFLRCPKPTLQQISHIAQQLGLEKDVVRVWFCNRRQKGKRSSSGYAQREDFEAVGSPFSGGPVSFPLAPGPHFGTPGYGSPHFTALYSSVPFPEGEAFPPVSVTTLGSPMHSN

SEQ ID NO: 766667 - protein, 103 aa, Homo sapiens
VLVQMGFHHVGQAGLKPLNSGDLPALASQSAGITGVSYCAWPKVRILKGTLQDMLRFSQSVSFRVAEWSHRVNISGSKPFTQYDVVELEKTTTTTTTKNPKKL

SEQ ID NO: 766668 - protein, 353 aa, Homo sapiens
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 766669 - protein, 113 aa, Homo sapiens
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWSKSQ

SEQ ID NO: 766670 - protein, 353 aa, Homo sapiens; identical to SEQ ID NO: 766668

SEQ ID NO: 766671 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 766672 - protein, 745 aa, Homo sapiens; identical to SEQ ID NO: 766671

SEQ ID NO: 766673 - protein, 745 aa, Homo sapiens; identical to SEQ ID NO: 766671

SEQ ID NO: 766674 - protein, 73 aa, Homo sapiens
EAALRPEVSLERRGPEMKPAVDEMFPEGAGPYVDLDEAGGSTGLLMDLAANEKAVHADFFNDFEDLFDDDDIQ

SEQ ID NO: 766675 - protein, 73 aa, Homo sapiens; identical to SEQ ID NO: 766674

SEQ ID NO: 766676 - protein, 106 aa, Homo sapiens
MLRRLGGELLFDEQHYYYYPGGALAVKKEKRGTTRTNNITPSSRSEATKRNYQRQHHTAHSNKHRSNRKYLRNPPSPHRSTYTTLPQHIHRHTTKSNNNDDPHQNA

SEQ ID NO: 766677 - protein, 86 aa, Homo sapiens
SHFPANVCLRAGDSVERSFSNKAELLFQLHGHQRESLSKKEAQVWRDKGLYFRKGLLDQAQTLIRADNMSSLHYCKNFFVYGSVVN

SEQ ID NO: 766678 - protein, 289 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 766679 - protein, 251 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGLPPLQTFSCPAWASRLGLSPSHPVPRFCRRNGP

SEQ ID NO: 766680 - protein, 83 aa, Homo sapiens
RRAPGPQDPWGGAGAVTREPGTLGPEGAGGGSERPEDAERPGTEPSVGSKAAESCGSQRGQGRTRESSWGGATGAGRGQVGAV

SEQ ID NO: 766681 - protein, 289 aa, Homo sapiens; identical to SEQ ID NO: 766678

SEQ ID NO: 766682 - protein, 328 aa, Homo sapiens
MQRGLALSLVSGARRQSHAAASAGRDARGNRAGVAPPEQEGDRYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 766683 - protein, 331 aa, Homo sapiens
MAFPSVPASPSLLPQYTCQPFCTEGHLSVMPLEWEQNSPRYFFSPRYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 766684 - protein, 139 aa, Homo sapiens
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDNTFRGAQFCLI

SEQ ID NO: 766685 - protein, 273 aa, Homo sapiens
ASRAGVNRTRVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 766686 - protein, 113 aa, Homo sapiens [sequence omitted]

SEQ ID NO: 766687 - protein, 196 aa, Homo sapiens
IFKEQIDIFEGIKDSQAQRMAENLGFVGPLKSQAADQISKLDNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIAHGDHQSLPGS

SEQ ID NO: 766688 - protein, 104 aa, Homo sapiens
QNYKTVSENIPKECLENIFFQVDREFVRLHHWHHFIITIPLRSSRRGELSQLELQRKKHSIYKVLELKNTMNKVKSETETISSRISQAKERICKIEDELFENIQ

SEQ ID NO: 766689 - protein, 975 aa, Homo sapiens
MIATISPAASNIEETLSTLRYANQARLIVNIAKVNEDMNAKLIRELKAEIAKLKAAQRNSRNIDPERYRLCRQEITSLRMKLHQQERDMAEMQRVWKEKFEQAEKRKLQETKELQKAGIMFQMDNHLPNLVNLNEDPQLSEMLLYMIKEGTTTVGKYKPNSSHDIQLSGVLIADDHCTIKNFGGTVSIIPVGEAKTYVNGKHILEITVLRHGDRVILGGDHYFRFNHPVEVQKGKRPSGRDTPISEGPKDFEFAKNELLMAQRSQLEAEIKEAQLKAKEEMMQGIQIAKEMAQQELSSQKAAYESKIKALEAELREESQRKKMQEINNQKANHKIEELEKAKQHLEQEIYVNKKRLEMETLATKQALEDHSIRHARILEALETEKQKIAKEVQILQQNRNNRDKTFTVQTTWSSMKLSMMIQEANAISSKLKTYYVFGRHDISDKSSSDTSIRVRNLKLGISTFWSLEKFESKLAAMKELYESNGSNRGEDAFCDPEDEWEPDITDAPVSSLSRRRSRSLMKNRRISGCLHDIQVHPIKNLHSSHSSGLMDKSSTIYSNSAESFLPGICKELIGSSLDFFGQSYDEERTIADSLINSFLKIYNGLFAISKAHEEQDEESQDNLFSSDRAIQSLTIQTACAFEQLVVLMKHWLSDLLPCTNIARLEDELRQEVKKLGGYLQLFLQGCCLDISSMIKEAQKNAIQIVQQAVKYVGQLAVLKGSKLHFLENGNNKAASVQEEFMDAVCDGVGLGMKILLDSGLEKAKELQHELFRQCTKNEVTKEMKTNAMGLIRSLENIFAESKIKSFRRQVQEENFEYQDFKRMVNRAPEFLKLKHCLEKAIEIIISALKGCHSDINLLQTCVESIRNLASDFYSDFSVPSTSVGSYESRVTHIVHQELESLAKSLLFCFESEESPDLLKPWETYNQNTKEEHQQSKSSGIDGSKNKGVPKRVYELHGSSPAVSSEECTPSRIQWV

SEQ ID NO: 766690 - protein, 1648 aa, Homo sapiens
MSLHSTHNRNNSGDILDIPSSQNSSSLNALTHSSRLKLHLKSDMSECENDDPLLRSAGKVRDINRTYVISASRKTADMPLTPNPVGRLALQRRTTRNKESSLLVSELEDTTEKTAETRLTLQRRAKTDSAEKWKTAEIDSVKMTLNVGGETENNGVSKESRTNVRIVNNAKNSFVASSVPLDEDPQVIEMMADKKYKETFSAPSRANENVALKYSSNRPPIASLSQTEVVRSGHLTTKPTQSKLDIKVLGTGNLYHRSIGKEIAKTSNKFGSLEKRTPTKCTTEHKLTTKCSLPQLKSPAPSILKNRMSNLQVKQRPKSSFLANKQERSAENTILPEEETVVQNTSAGKDPLKVENSQVTVAVRVRPFTKREKIEKASQVVFMSGKEITVEHPDTKQVYNFIYDVSFWSFDECHPHYASQTTVYEKLAAPLLERAFEGFNTCLFAYGQTGSGKSYTMMGFSEEPGIIPRFCEDLFSQVARKQTQEVSYHIEMSFFEVYNEKIHDLLVCKDENGQRKQPLRVREHPVYGPYVEALSMNIVSSYADIQSWLELGNKQRATAATGMNDKSSRSHSVFTLVMTQTKTEFVEGEEHDHRITSRINLIDLAGSERCSTAHTNGDRLKEGVSINKSLLTLGKVISALSEQANQRSVFIPYRESVLTWLLKESLGGNSKTAMIATISPAASNIEETLSTLRYANQARLIVNIAKVNEDMNAKLIRELKAEIAKLKAAQRNSRNIDPERYRLCRQEITSLRMKLHQQERDMAEMQRVWKEKFEQAEKRKLQETKELQKAGIMFQMDNHLPNLVNLNEDPQLSEMLLYMIKEGTTTVGKYKPNSSHDIQLSGVLIADDHCTIKNFGGTVSIIPVGEAKTYVNGKHILEITVLRHGDRVILGGDHYFRFNHPVEVQKGKRPSGRDTPISEGPKDFEFAKNELLMAQRSQLEAEIKEAQLKAKEEMMQGIQIAKEMAQQELSSQKAAYESKIKALEAELREESQRKKMQEINNQKANHKIEELEKAKQHLEQEIYVNKKRLEMETLATKQALEDHSIRHARILEALETEKQKIAKEVQILQQNRNNRDKTFTVQTTWSSMKLSMMIQEANAISSKLKTYYVFGRHDISDKSSSDTSIRVRNLKLGISTFWSLEKFESKLAAMKELYESNGSNRGEDAFCDPEDEWEPDITDAPVSSLSRRRSRSLMKNRRISGCLHDIQVHPIKNLHSSHSSGLMDKSSTIYSNSAESFLPGICKELIGSSLDFFGQSYDEERTIADSLINSFLKIYNGLFAISKAHEEQDEESQDNLFSSDRAIQSLTIQTACAFEQLVVLMKHWLSDLLPCTNIARLEDELRQEVKKLGGYLQLFLQGCCLDISSMIKEAQKNAIQIVQQAVKYVGQLAVLKGSKLHFLENGNNKAASVQEEFMDAVCDGVGLGMKILLDSGLEKAKELQHELFRQCTKNEVTKEMKTNAMGLIRSLENIFAESKIKSFRRQVQEENFEYQDFKRMVNRAPEFLKLKHCLEKAIEIIISALKGCHSDINLLQTCVESIRNLASDFYSDFSVPSTSVGSYESRVTHIVHQELESLAKSLLFCFESEESPDLLKPWETYNQNTKEEHQQSKSSGIDGSKNKGVPKRVYELHGSSPAVSSEECTPSRIQWV

SEQ ID NO: 766691 - protein, 192 aa, Homo sapiens
GASKLRLTRGNSCTVRPRAPSAHTEHTPTRAHTRSHSPPPRAPALDPRARTRSPALGVATPRAPRPPPSHPHARPAGGSPPRARKGDMPFGHVIVSTGSETFQKMKPATGLWVWVSLLVAAGTVQPSDSQSVCAGTENKLSSLSDLEQQYRALRKYYENCEVVMGNLEITSIEHNRDLSFLRVKLWLSFSSL

SEQ ID NO: 766692 - protein, 83 aa, Homo sapiens
SVREVTGYVLVALNQFRYLPLENLRIIRGTKLYEDRYALAIFLNYRKDGNFGLQELGLKNLTGKEYIQNGKYAFIINIRQLYM

SEQ ID NO: 766693 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 766694 - protein, 664 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCIGSSIEDCIGLMDRCNGPTSHDCIYYPWTGHSTLPQHAR

SEQ ID NO: 766695 - protein, 160 aa, Homo sapiens
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 766696 - protein, 194 aa, Homo sapiens [sequence omitted]

SEQ ID NO: 766697 - protein, 137 aa, Homo sapiens
DALALRLACIGDEMDVSLRAPRLAQLSEVAMHRYRPMPYASTPGEGPWAVGGGPEHSTGLGPEEALWGMCLDTGAILKPLAASRTSPGSPQLLALAPCHLSLAFLGNKAEPRALFSLAVLIEPRWYISTVVLRGGAT

SEQ ID NO: 766698 - protein, 194 aa, Homo sapiens [sequence omitted]

SEQ ID NO: 766699 - protein, 194 aa, Homo sapiens [sequence omitted]

SEQ ID NO: 766700 - protein, 73 aa, Homo sapiens
TKDPKERLGCHPQTGFADIQGHPFFRNVDWDMMEQKQVVPPFKPNISGEFGLDNFDSQFTNCPQEVLLKSEQV

SEQ ID NO: 766701 - protein, 676 aa, Homo sapiens
GGVLGPGGCRGGGAYGQWEEPRGSGCSGEATLGSALRARWAGRWADGRGSPASAGGGVPHGARSAPPHPRPPALRRGSEEMPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 766702 - protein, 150 aa, Homo sapiens
MAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 766703 - protein, 513 aa, Homo sapiens
GGVLGPGGCRGGGAYGQWEEPRGSGCSGEATLGSALRARWAGRWADGRGSPASAGGGVPHGARSAPPHPRPPALRRGSEEMPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGNK

SEQ ID NO: 766704 - protein, 676 aa, Homo sapiens; identical to SEQ ID NO: 766701

SEQ ID NO: 766705 - protein, 360 aa, Homo sapiens
MNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 766706 - protein, 513 aa, Homo sapiens; identical to SEQ ID NO: 766703

SEQ ID NO: 766707 - protein, 446 aa, Homo sapiens
SSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 766708 - protein, 271 aa, Homo sapiens
SSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 766709 - protein, 251 aa, Homo sapiens
MSCPLCKVSGPPPGCRGGSLAPLFSLCLGVLVSDSRLPVQTRVPRPLPSLSLLLALRGGLRLVLVSCRAGPGSGRVGHHHLTGLAGGTGLCGPAAICEARGDGGGGGWPVGFPQRGQVAWRERGSGTGSLVGGADAPRPGVVLPGHWWDPCSGLLSGCQLCLKDSWNLRTRSRSALGPGPHAGPGGTTQPGIVHGQRCSPRALLGSLTERLLWLKVGWGRGLGPPWLSPVRPGAPPAGSAPGLRWCGALSG

SEQ ID NO: 766710 - protein, 369 aa, Homo sapiens
SSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDSWPVWTLGHSLSLLCLRDVLSPSLFLLLLVCGPGQWLS

SEQ ID NO: 766711 - protein, 446 aa, Homo sapiens; identical to SEQ ID NO: 766707

SEQ ID NO: 766712 - protein, 446 aa, Homo sapiens; identical to SEQ ID NO: 766707

SEQ ID NO: 766713 - protein, 179 aa, Homo sapiens
DSETNTVSSEALPVLIGSWPARTFHPGACVSRRPSAPWKHTASGKDSPDLRFSEHGVSQEFWAGGLVAVLEMTPSPSPWGTQEGPAGMCSLWVVGWCPCRGAGVRDLVLVHAGVWCKHVCAVQRDACGESRTPAPPRKGGAVTSVLCLFLIKTFPLFSYKFASCKQVHKDPPLVKSGFE

SEQ ID NO: 766714 - protein, 446 aa, Homo sapiens; identical to SEQ ID NO: 766707

SEQ ID NO: 766715 - protein, 446 aa, Homo sapiens; identical to SEQ ID NO: 766707

SEQ ID NO: 766716 - protein, 104 aa, Homo sapiens
NFSPSPPTWIQIATCRTGQSFSLSDFLFNHLWANSPFSGAINYVAHSRCTIQGEGPFFQLVMITNYYCRLSCQPPYQPLSFGNNFFIVPQIVCAHCSTFFKNHK

SEQ ID NO: 766717 - protein, 206 aa, Homo sapiens
LDGCFPPAKTTTGEPSRRQLGNMKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 766718 - protein, 206 aa, Homo sapiens; identical to SEQ ID NO: 766717

SEQ ID NO: 766719 - protein, 122 aa, Homo sapiens
MEASALTSSAVTSVAKVVRVASGSAVVLPLARIATVVIGGVVAMAAVPMVLSAMGFTAAGIASSSIAAKMMSAAAIANGGGVASGSLVATLQSLGATGLSGLTKFILGSIGSAIAAVIARFY

SEQ ID NO: 766720 - protein, 122 aa, Homo sapiens; identical to SEQ ID NO: 766719

SEQ ID NO: 766721 - protein, 140 aa, Homo sapiens
GITPFGNTSKLKTVRSASHSQELSFFGQDCYSCDWRSCGHGGCAHGAQCHGLHCGGNRLVLHSSQDDVRGGHCQWGWSCLGQPCGYSAVTGSNWTLRIDQVHPGLHWVCHCGCHCEVLLAPCPSPCREENHARGEGTQPS

SEQ ID NO: 766722 - protein, 122 aa, Homo sapiens; identical to SEQ ID NO: 766719

SEQ ID NO: 766723 - protein, 122 aa, Homo sapiens; identical to SEQ ID NO: 766719

SEQ ID NO: 766724 - protein, 122 aa, Homo sapiens; identical to SEQ ID NO: 766719

SEQ ID NO: 766725 - protein, 112 aa, Homo sapiens
RPPTTTKFAAASTKFILGFIGSAIAAVIGGSTVVIGGVVAMAAVPMVLSAMGFTAAGIASSSIAAKMMSAAAIANGGGVASGSLVATLQSLGEKAPSHPDPARSQLSQIYLG

SEQ ID NO: 766726 - protein, 122 aa, Homo sapiens; identical to SEQ ID NO: 766719

SEQ ID NO: 766727 - protein, 122 aa, Homo sapiens; identical to SEQ ID NO: 766719

SEQ ID NO: 766728 - protein, 122 aa, Homo sapiens; identical to SEQ ID NO: 766719

SEQ ID NO: 766729 - protein, 1040 aa, Homo sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 766730 - protein, 97 aa, Homo sapiens
SSHHDLCRLALEHWNSLASTPSILQLLTDTGTQKPSSLPVRYSSPRATQKLWFHLKAHPCLAPFISVSCFIPLTPYCSPLGALPSTSFAPELLAPFF

SEQ ID NO: 766731 - protein, 101 aa, Homo sapiens
GLSRKTEQTIDTCDHTDDFHLKGIMPKEGNHTQKTTYSVVPFIGNSGKGKAVGTESRSVVTRVCGERKALTVKGYEGIFSGFGNVLYHFSGNDMNVYICPD

SEQ ID NO: 766732 - protein, 191 aa, Homo sapiens
RYPARLRSDSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIGKVIISVSSVMHDMCACFKNDKYLVNQSLGNSPATPEAKAI

SEQ ID NO: 766733 - protein, 864 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQQPAIAQFPVVSQGGSQQQLMQNFYQQQQQQQQQQQQQQLATALHQQQLMTQQAALQQKPTMAAGQQPQPQPAAAPQPAPAQEPAQIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIGKVIISVSSVMHDMCACFKNDKYLVNQSLGNSPATPEAKAI

SEQ ID NO: 766734 - protein, 466 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQ

SEQ ID NO: 766735 - protein, 466 aa, Homo sapiens; identical to SEQ ID NO: 766734

SEQ ID NO: 766736 - protein, 466 aa, Homo sapiens; identical to SEQ ID NO: 766734

SEQ ID NO: 766737 - protein, 758 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQQPAIAQFPVVSQGGSQQQLMQNFYQQQQQQQQQQQQQQLATALHQQQLMTQQAALQQKPTMAAGQQPQPQPAAAPQPAPAQEPAQIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTG

SEQ ID NO: 766738 - protein, 501 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAHSSNNNSNSNSWPQPCINNS

SEQ ID NO: 766739 - protein, 328 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSP

SEQ ID NO: 766740 - protein, 308 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPEPDYSRIQSGIL

SEQ ID NO: 766741 - protein, 219 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKK

SEQ ID NO: 766742 - protein, 114 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGTRIFGVQSGGPLEYP

SEQ ID NO: 766743 - protein, 466 aa, Homo sapiens; identical to SEQ ID NO: 766734

SEQ ID NO: 766744 - protein, 547 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQTPPLSPASPSQKRVEDEMKAMGLLEDTQCLFWVREVLTKGFSNKNKCH

SEQ ID NO: 766745 - protein, 362 aa, Homo sapiens
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKASMKEIYTSKHI

SEQ ID NO: 766746 - protein, 646 aa, Homo sapiens
AGYSEDPADCADLMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQQPAIAQFPVVSQGGSQQQLMQNFYQQQQQQQQQQQQQQLATALHQQQLMTQQAALQQKPTMAAGQQPQPQPAAAPQPAPAQEPAQIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTG

SEQ ID NO: 766747 - protein, 389 aa, Homo sapiens
TQGRAAADKTCPAGCCCAGGGCCCCCCCLRKSCCRIQQSAWPFSQCSPTKTPSPTQPASAANSGQAATGSSHSTADAFYSGPGSARSGPGHTPAPAATLPQAATAAATATASTAAAGRHVLPAAAGPDSAVSGSTSSNPATSNCSVPCGVPRRLSTAANAEFLPAAAAAAQQQQQQQLATALHQQQLMTQQAALQQKPTMAAGQQPQPQPAAAPQPAPAQEPAQIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTG

SEQ ID NO: 766748 - protein, 191 aa, Homo sapiens
VEATRLPPRPLLQEYAGIVVQQPDCAELTFPSLPCGSGDINSLFQNSVCTETLFPQSSSRGRLLPIRGDRTAVAGEAPVPRRAAPRGTSGGGSLPGWVDGAGRERARGRGGGSVSARRSRDQLAGGREPSAAPALAAAPPLLCVAGRPGGRDNVAGLVAGRRPPSRLKFKLTRIAFWRRRGPAARLTRIFL

SEQ ID NO: 766749 - protein, 142 aa, Homo sapiens
MNSLEQAEAPRVVSLIPAVVSGNCQDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 766750 - protein, 125 aa, Homo sapiens
MNSLEQAEDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 766751 - protein, 338 aa, Homo sapiens
MDPNTIIEALRGTMDPALREAAERQLNEAHKSLNFVSTLLQITMSEQLDLPVRQAGVIYLKNMITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKKPEERSPLVAAMQHFLPVLKDRFIQLLSDQSDQSVLIQKQIFKIFYALVQYTLPLELINQQNLTEWIEILKTVVNRDVPNETLQVEEDDRPELPWWKCKKWALHILARLFERYGSPGNVSKEYNEFAEVFLKAFAVGVQQVLLKVLYQYKEKQYMAPRVLQQALQQVHELDSLPSS

SEQ ID NO: 766752 - protein, 76 aa, Homo sapiens
LGAFELLVKNYEYKKPEERSPLVAAMQHFLPVLKDRFIQLLSDQSDQSVLIQKQIFKIFYALVQVISVKQFLCIKS

SEQ ID NO: 766753 - protein, 1038 aa, Homo sapiens
MDPNTIIEALRGTMDPALREAAERQLNEAHKSLNFVSTLLQITMSEQLDLPVRQAGVIYLKNMITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKKPEERSPLVAAMQHFLPVLKDRFIQLLSDQSDQSVLIQKQIFKIFYALVQYTLPLELINQQNLTEWIEILKTVVNRDVPNETLQVEEDDRPELPWWKCKKWALHILARLFERYGSPGNVSKEYNEFAEVFLKAFAVGVQQVLLKVLYQYKEKQYMAPRVLQQTLNYINQGVSHALTWKNLKPHIQGIIQDVIFPLMCYTDADEELWQEDPYEYIRMKFDVFEDFISPTTAAQTLLFTACSKRKEVLQKTMGFCYQILTEPNADPRKKDGALHMIGSLAEILLKKKIYKDQMEYMLQNHVFPLFSSELGYMRARACWVLHYFCEVKFKSDQNLQTALELTRRCLIDDREMPVKVEAAIALQVLISNQEKAKEYITPFIRPVMQALLHIIRETENDDLTNVIQKMICEYSEEVTPIAVEMTQHLAMTFNQVIQTGPDEEGSDDKAVTAMGILNTIDTLLSVVEDHKEITQQLEGICLQVIGTVLQQHVLEFYEEIFSLAHSLTCQQVSPQMWQLLPLVFEVFQQDGFDYFTDMMPLLHNYVTVDTDTLLSDTKYLEMIYSMCKKVLTGVAGEDAECHAAKLLEVIILQCKGRGIDQCIPLFVEAALERLTREVKTSELRTMCLQVAIAALYYNPHLLLNTLENLRFPNNVEPVTNHFITQWLNDVDCFLGLHDRKMCVLGLCALIDMEQIPQVLNQVSGQILPAFILLFNGLKRAYACHAEHENDSDDDDEAEDDDETEELGSDEDDIDEDGQEYLEILAKQAGEDGDDEDWEEDDAEETALEGYSTIIDDEDNPVDEYQIFKAIFQTIQNRNPVWYQALTHGLNEEQRKQLQDIATLADQRRAAHESKMIEKHGGYKFSAPVVPSSFNFGGPAPGMN

SEQ ID NO: 766754 - protein, 1038 aa, Homo sapiens; identical to SEQ ID NO: 766753

SEQ ID NO: 766755 - protein, 1038 aa, Homo sapiens; identical to SEQ ID NO: 766753

SEQ ID NO: 766756 - protein, 1038 aa, Homo sapiens; identical to SEQ ID NO: 766753

SEQ ID NO: 766757 - protein, 1038 aa, Homo sapiens; identical to SEQ ID NO: 766753

SEQ ID NO: 766758 - protein, 1038 aa, Homo sapiens; identical to SEQ ID NO: 766753

SEQ ID NO: 766759 - protein, 1038 aa, Homo sapiens; identical to SEQ ID NO: 766753

SEQ ID NO: 766760 - protein, 1038 aa, Homo sapiens; identical to SEQ ID NO: 766753

SEQ ID NO: 766761 - protein, 1038 aa, Homo sapiens; identical to SEQ ID NO: 766753

SEQ ID NO: 766762 - protein, 722 aa, Homo sapiens
MAPRVLQQTLNYINQGVSHALTWKNLKPHIQGIIQDVIFPLMCYTDADEELWQEDPYEYIRMKFDVFEDFISPTTAAQTLLFTACSKRKEVLQKTMGFCYQILTEPNADPRKKDGALHMIGSLAEILLKKKIYKDQMEYMLQNHVFPLFSSELGYMRARACWVLHYFCEVKFKSDQNLQTALELTRRCLIDDREMPVKVEAAIALQVLISNQEKAKEYITPFIRPVMQALLHIIRETENDDLTNVIQKMICEYSEEVTPIAVEMTQHLAMTFNQVIQTGPDEEGSDDKAVTAMGILNTIDTLLSVVEDHKEITQQLEGICLQVIGTVLQQHVLEFYEEIFSLAHSLTCQQVSPQMWQLLPLVFEVFQQDGFDYFTDMMPLLHNYVTVDTDTLLSDTKYLEMIYSMCKKVLTGVAGEDAECHAAKLLEVIILQCKGRGIDQCIPLFVEAALERLTREVKTSELRTMCLQVAIAALYYNPHLLLNTLENLRFPNNVEPVTNHFITQWLNDVDCFLGLHDRKMCVLGLCALIDMEQIPQVLNQVSGQILPAFILLFNGLKRAYACHAEHENDSDDDDEAEDDDETEELGSDEDDIDEDGQEYLEILAKQAGEDGDDEDWEEDDAEETALEGYSTIIDDEDNPVDEYQIFKAIFQTIQNRNPVWYQALTHGLNEEQRKQLQDIATLADQRRAAHESKMIEKHGGYKFSAPVVPSSFNFGGPAPGMN

SEQ ID NO: 766763 - protein, 1038 aa, Homo sapiens; identical to SEQ ID NO: 766753

SEQ ID NO: 766764 - protein, 1038 aa, Homo sapiens; identical to SEQ ID NO: 766753

SEQ ID NO: 766765 - protein, 1038 aa, Homo sapiens; identical to SEQ ID NO: 766753

SEQ ID NO: 766766 - protein, 1038 aa, Homo sapiens; identical to SEQ ID NO: 766753

SEQ ID NO: 766767 - protein, 2322 aa, Homo sapiens
MQSGRGPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGAHYGELELDILGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHCGGPAQDLTFRVSDGLQASPPATLKVVAIRPAIQIHRSTGLRLAQGSAMPILPANLSVETNAVGQDVSVLFRVTGALQFGELQKHSTGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRLGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPEDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGPLQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFPFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 766768 - protein, 313 aa, Homo sapiens
PEVPGRVPRANVSCKVRLETGDMAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPLQAFFLVADDIMDVIPYPPGTDLWYQKPGVGLDAIKMMLTSLEACIYPLLKLYWREQAYYTETDRALLQSSYQTEMGR

SEQ ID NO: 766769 - protein, 146 aa, Homo sapiens [sequence omitted]

SEQ ID NO: 766770 - protein, 163 aa, Homo sapiens
MMNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 766771 - protein, 121 aa, Homo sapiens
MLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 766772 - protein, 131 aa, Homo sapiens [sequence omitted]

SEQ ID NO: 766773 - protein, 131 aa, Homo sapiens [sequence omitted]

SEQ ID NO: 766774 - protein, 268 aa, Homo sapiens
PEVPGRVPRANVSCKVRLETGDMAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 766775 - protein, 262 aa, Homo sapiens
MARYEAGVIGRGETGDMAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 766776 - protein, 88 aa, Homo sapiens
PEVPGRVPRANVSCKVRLETGDMAAPGPALCLFDVDGTLTAPRQKITKEMDDFLQKLRQKIKIGVVGGSDFEKVQEQLGNDEYSKSSG

SEQ ID NO: 766777 - protein, 141 aa, Homo sapiens
PEVPGRVPRANVSCKVRLETGDMAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRKKI

SEQ ID NO: 766778 - protein, 131 aa, Homo sapiens [sequence omitted]

SEQ ID NO: 766779 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 766780 - protein, 720 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYEPLNSDVQYTEVQVSSAESHKDLGKKDTETVYSEVRKAVPDAVESRYSRTEGSLDGT

SEQ ID NO: 766781 - protein, 727 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPENGRLP

SEQ ID NO: 766782 - protein, 746 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPVELGYLRCSLPCHPLFCRCRGKQIL

SEQ ID NO: 766783 - protein, 756 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPVELGYLRCSLPCHPLFCRCRGKQILCKYTFHIHYI

SEQ ID NO: 766784 - protein, 218 aa, Homo sapiens
MAIPGRQNIVLRSHRKRYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSV

SEQ ID NO: 766785 - protein, 238 aa, Homo sapiens
MAIPGRQYGLILPKKTQQLHPVLQKPSVFGNDSDDDDEERRGFIRLATLISNSSAQVIQPPQPPKALGLQTSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREAR

SEQ ID NO: 766786 - protein, 558 aa, Homo sapiens
MAIPGRQYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766787 - protein, 504 aa, Homo sapiens
MKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766788 - protein, 599 aa, Homo sapiens
MAIPGRQYGLILPKKTQQLHPVLQKPSVFGNDSDDDDEMGFHSCCPGWSAMVQSRLTEPPPPGFKRFSCLSLPNSCNYQTSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766789 - protein, 623 aa, Homo sapiens
RPRSADTGARWRFRAGRHLAVNPSGTCCLSSTDPHGSSLSKQMRAATSTWLDCCSDVTFSTRWGFTLVAQAGVQWCNLGSPQPPPPGFKRFSCLSLPNSCNYQTSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766790 - protein, 400 aa, Homo sapiens
ELEDPVLSTTEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766791 - protein, 264 aa, Homo sapiens
SRGSPNKNTLKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766792 - protein, 558 aa, Homo sapiens; identical to SEQ ID NO: 766786

SEQ ID NO: 766793 - protein, 558 aa, Homo sapiens; identical to SEQ ID NO: 766786

SEQ ID NO: 766794 - protein, 504 aa, Homo sapiens; identical to SEQ ID NO: 766787

SEQ ID NO: 766795 - protein, 568 aa, Homo sapiens
MAIPGRQNIVLRSHRKRYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766796 - protein, 457 aa, Homo sapiens
ADSDFDAKSSADDVIEETRVNCRREKVIETPENDFKHHRSRNHSRSPSVERGQQYGKKKEKKRAAVLEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 766797 - protein, 138 aa, Homo sapiens [sequence omitted]

SEQ ID NO: 766798 - protein, 549 aa, Homo sapiens
MAIPGRQYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSLFERLRQEDHLSLGI

SEQ ID NO: 766799 - protein, 362 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWPSLKGVSSWGLYQEKTLPPLFA

SEQ ID NO: 766800 - protein, 288 aa, Homo sapiens
PRFKGSPAVLFKLTYAVITCFSLRLTHPPRPWSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 766801 - protein, 271 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGRFPRSLFFPPWPAQPASVPLYHWPLSSLRPQL

SEQ ID NO: 766802 - protein, 175 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGA

SEQ ID NO: 766803 - protein, 271 aa, Homo sapiens; identical to SEQ ID NO: 766801

SEQ ID NO: 766804 - protein, 36 aa, Homo sapiens
MTARPSPQAPLPPPALLMLEHQGSVLSLLFSFHHVQ

SEQ ID NO: 766805 - protein, 2221 aa, Homo sapiens
MALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPW

SEQ ID NO: 766806 - protein, 2171 aa, Homo sapiens
MALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIM

SEQ ID NO: 766807 - protein, 238 aa, Homo sapiens
SGVLGTPPFCAWVNSSGDPYVSWGMPPPLSCLLAFRACHSGHSHGLVTRTLSCCSSTQGPPPPPLPCHQEAGSAWPLSPVSSGDGEGRTHRLCHGHLGSGCAHLHYVSVPYPTAALSAHTVSSRTHLLPTPSPPCPTSPVHTSTLHTHTQVHSSMALSTVHLTLMSFWVWVLASGLHMSIKLSSPTGSVDAPRSMSQTPRKRRLGLWGAALMPSSCTPIHPRAPPSSCERFSLYIPGE

SEQ ID NO: 766808 - protein, 140 aa, Homo sapiens
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEVSSCSLWIYSPGKILGLCFSCISARVYPKNNFLMHIYKASEEDLE

SEQ ID NO: 766809 - protein, 97 aa, Homo sapiens
RCSPSLPLASALSYSFSQLLNYSSHWNLHNQKQLSSLKPPPGAHHLEKSDSLPAPAAEEQPGSWGRGGVPFSRSVRATASPRRLAVSHRPAPRVLQR

SEQ ID NO: 766810 - protein, 107 aa, Homo sapiens
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEILCKTSGQLTSP

SEQ ID NO: 766811 - protein, 1482 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGSERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 766812 - protein, 1399 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 766813 - protein, 1361 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVRALTSWLRLHMGRLSK

SEQ ID NO: 766814 - protein, 1361 aa, Homo sapiens; identical to SEQ ID NO: 766813

SEQ ID NO: 766815 - protein, 1361 aa, Homo sapiens; identical to SEQ ID NO: 766813

SEQ ID NO: 766816 - protein, 1361 aa, Homo sapiens; identical to SEQ ID NO: 766813

SEQ ID NO: 766817 - protein, 1208 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQVSGSQRVFCSRFTWQLGGLKVEQLMEKRRQLLN

SEQ ID NO: 766818 - protein, 108 aa, Homo sapiens
DFGGKSQMPKIYSLGRLSTRLFQDTVVALHALSRYGAATFTRTEKTAQVTVQDSQTFSTNFQVDNNNLLLLQQISLPELPGEYVITVTGERCVYLQVGLQAYMGESQL

SEQ ID NO: 766819 - protein, 1014 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAVKYKGELQRGTAISDPPELKRAKENQKNISNVYYRGQLGRATTLSVTPEMERVKKNQENISSVKYTQDHKQMKGRPSLILDTPAMRHVKEAQNHISMVKYHEDFEKTKGRGFTPVVDDPVTERVRKNTQVVSDAAYKGVHPHIVEMDRRPGIIVDLKVWRTDPGSIFDLDPLEDNIQSRSLHMLSEKASHYRRHWSRSHSSSTFGTGLGDDRSEISEIYPSFSCCSEVTRPSDEGAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 766820 - protein, 1014 aa, Homo sapiens; identical to SEQ ID NO: 766819

SEQ ID NO: 766821 - protein, 2376 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAASRFCFLLYFLKHNIFLFKNMPFGRPLSFSKLTQERKTKYCIIMRAEMMRIHGHIEGNNRHRSLLDGRGWEEGEDPEKYLLSTGLNAGVMKSSVQQTPITQVHLCNKPAHVPLNLKVLKENEFEQHAIIWMNHIIKHEKVICTCSINSFVKFNNCNNNDDDKRNISRFNKLSKNLKRKSFTPSAFLDVPFHISLLKGMNCVSRKFGTVLLYLSCVCFIQEIFIKYPNVLGIVLVTQTQRWVKYKGELQRGTAISDPPELKRAKENQKNISNVYYRGQLGRATTLSVTPEMERVKKNQENISSVKYTQDHKQMKGRPSLILDTPAMRHVKEAQNHISMVKYHEDFEKTKGRGFTPVVDDPVTERVRKNTQVVSDAAYKGVHPHIVEMDRRPGIIVDLKVWRTDPGSIFDLDPLEDNIQSRSLHMLSEKASHYRRHWSRSHSSSTFGTGLGDDRSEISEIYPSFSCCSEVTRPSDEGAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVELIISPCPLSFILMYPKPNLFKREKILLRQLGHYFTMMYPSFDNETHRYQEEGMTSGLKTAAFSVIPTNKNLCVWTLVLLIVFMVSFDWLLNPSGKCIFVDFNREVDCPLNVACVGNFLAVTLESPQANSLNSVMQPIIQTRFAFEIMRQFPILVKIAQYNKCKQWQKDSLVKIILTGGLRDLETSTKQRNFLVPQADWYLFISHLYQGISYSPFIFYGPKSMLSSTECQDQITSQLLCKGQIIMSLYNFPSSIYPVACHVDSSFCNMAAALRVPIIEAKRVTDDLKALSSSSRQLIRKTYFEKMLEIFLLHRTLFGRIYILGNNMYTLVNKRFRCSIEQLVINLMPPLISNEENVTEASEAMEAGAVTGKILSKQSYQFHTEMIWCLLLENGIQILEWKSSHQNGLIKRRPFPFFLLLFSEIIFKGMKQECHQRFFSTGPRACTLRKKFLPCMNFRISDFAGFCSALAGGSGNYIQSLQSRSPSQRHPSATLCFSDCAVYCDLQRGGIHLGSDFTAMTKPKKQNCKEVLRCTGLGDICLICYIQGELTKHPVKHRLRKRLLVQRPKLIYFHFRKVQHMLLKICDFILLAKRVNRLYYTEAASICHLHKVEKINAGKYLETSFKGVWLVSLTEMASRDESDKTPYLFWYIVHKPTKINWTCNIFAKKSVVKTEDKIPAQFYFTKYIFTFHPGRPFSFVIIRKSELLIKFSDLNIGQVQFWINSTFIRTAMKTDLKYMLVIRKVISSTDFKTRFTEHKSQYIFEELSLLKFYASRNNVCIAKYFCFKPLGIKICSEFNYKGSCFTMKTKTEQDVACSSGHNLVVLAVVNKACQDVKHLRRNIGKLYVSNQSAIFKSIIYKKMTCLNNFSTFHVLPSHLWFGNRYLVHEADSYKKILKIELKMTVEMSKHREHAPDFLKFDVFSSLTEAQGTVRYTFKRVLKTKLYRDPLSLEQSIATEYIAFVVSFCVHVFTNNSCSLESFLFLTYGKMNPSCLLVIVYTLAVEPSLKYLFGYQLPMEEALDDPRSPRPPYTTQAFVSTVFHKHLVGIWIRLDQPLSVHWVYFLKKMQIWFFQCATVFPYPLHAELDNTLGMRNKTFSKKIVEVQGMYLVFRFIHLQWNVFNKR

SEQ ID NO: 766822 - protein, 1070 aa, Homo sapiens
MTSGLKTAAFSVIPTNKNLCVWTLVLLIVFMVSFDWLLNPSGKCIFVDFNREVDCPLNVACVGNFLAVTLESPQANSLNSVMQPIIQTRFAFEIMRQFPILVKIAQYNKCKQWQKDSLVKIILTGGLRDLETSTKQRNFLVPQADWYLFISHLYQGISYSPFIFYGPKSMLSSTECQDQITSQLLCKGQIIMSLYNFPSSIYPVACHVDSSFCNMAAALRVPIIEAKRVTDDLKALSSSSRQLIRKTYFEKMLEIFLLHRTLFGRIYILGNNMYTLVNKRFRCSIEQLVINLMPPLISNEENVTEASEAMEAGAVTGKILSKQSYQFHTEMIWCLLLENGIQILEWKSSHQNGLIKRRPFPFFLLLFSEIIFKGMKQECHQRFFSTGPRACTLRKKFLPCMNFRISDFAGFLLALAGGSGNYIQSLQSRSPSQRHPSATLCFSDCAVYCDLQRGGIHLGSDFTAMTKPKKQNCKEVLRCTGLGDICLICYIQGELTKHPVKHRLRKRLLVQRPKLIYFHFRKVQHMLLKICDFILLAKRVNRLYYTEAASICHLHKVEKINAGKELETSFKGVWLVSLTEMASRDESDKTPYLFWYIVHKPTKINWTCNIFAKKSVVKTEDKIPAQFYFTKYIFTFHPGRPFSFVIIRKSELLIKFSDLNIGQVQFWINSTFIRTAMKTDLKYMLVIRKVISSTDFKTRFTEHKSQYIFEEISLLKFYASRNNVCIAKYFCFKPLGIKICSEFNYKGSCFTMKTKTEQDVACSSGHNLVVLAVVNKACQDVKHLRRNIGKLYVSNQSAIFKSIIYKKMTCLNNFSTFHVLPSHLWFGNRYLVHEADSYKKILKIELKMTVYMSKHREHAPDFLKFDVFSSLTEAQGTVRYTFKRLLKTKLYRDPLSLEQSIATEYIAFVVSFCVHVFTNNSCSLESFLFLTYGKMNPSCLLVIVYTLAVEPSLKYLFGYQLPMEEALDDPRSPRPPYTTQAFVSTVFHKHLVGIWIRLDQPLSVHWVYFLKKMQIWFFQCATVFPYPLHAELDNTLGMRNKTFSKKIVEVQGMYLVFRFIHLQWNVFNKR

SEQ ID NO: 766823 - protein, 280 aa, Homo sapiens
ATAGPREAAIMNPQCARCGKVVYPTEKVNCLDKYWHKGCFHCEVCKMALNMNNYKGYEKKPYCNAHYPKQSFTTVADTPENLRLKQQSELQSQVKYKRDFEESKGRGFSIVTDTPELQRLKRTQEQISNVKYHEDFEKTKGRGFTPVVDDPVTERVRKNTQVVSDAAYKGVHPHIVEMDRRPGIIVAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 766824 - protein, 2376 aa, Homo sapiens; identical to SEQ ID NO: 766821

SEQ ID NO: 766825 - protein, 716 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAASRFCFLLYFLKHNIFLFKNMPFGRPLSLAN

SEQ ID NO: 766826 - protein, 716 aa, Homo sapiens; identical to SEQ ID NO: 766825

SEQ ID NO: 766827 - protein, 561 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQVGHE

SEQ ID NO: 766828 - protein, 628 aa, Homo sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 766829 - protein, 683 aa, Homo sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTVPLLQQNLLCSRPQSPMFGGHLSDILGVPLLGHQLPPAQTLGDCTKGANIGIKDKERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 766830 - protein, 106 aa, Homo sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTGESSGGQSGGPIIFVF

SEQ ID NO: 766831 - protein, 252 aa, Homo sapiens
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRTSIQRDLKEQQPQALAPGRGPSHSSAFSMSPLSTAQAPLPNPRTAASIYEELLKHDTNIYCRMDHKAEVAS

SEQ ID NO: 766832 - protein, 212 aa, Homo sapiens
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRPWSLPQLCLLDVPSLHCPGPPTQPQDSSFHL

SEQ ID NO: 766833 - protein, 177 aa, Homo sapiens
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYPELPKPSISSNNSNPKEDKDAVAFTCEPEIHSTTCL

SEQ ID NO: 766834 - protein, 177 aa, Homo sapiens; identical to SEQ ID NO: 766833

SEQ ID NO: 766835 - protein, 137 aa, Homo sapiens
MPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYPELPKPSISSNNSNPKEDKDAVAFTCEPEIHSTTCL

SEQ ID NO: 766836 - protein, 44 aa, Homo sapiens
MTQTFTAGWTTKQKWLLSFLQELLLWVDGESPRPPALGMGKDMK

SEQ ID NO: 766837 - protein, 142 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 766838 - protein, 142 aa, Homo sapiens; identical to SEQ ID NO: 766837

SEQ ID NO: 766839 - protein, 1103 aa, Homo sapiens
TCVQSVLQATQRPRVPGRLRPLSAAKPLRPSQRPGPRPGLDFLAGTVMASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 766840 - protein, 1103 aa, Homo sapiens; identical to SEQ ID NO: 766839

SEQ ID NO: 766841 - protein, 649 aa, Homo sapiens
MSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 766842 - protein, 403 aa, Homo sapiens [sequence omitted]

SEQ ID NO: 766843 - protein, 506 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766844 - protein, 87 aa, Homo sapiens
ANSAEFPNPEDIVLTQSPLAPARYWHRSLNPRKLIEVKFSHLSRNMTMQRTMKLYRLPENQGRPEASVLLCCKMKAGLQADYTYGGC

SEQ ID NO: 766845 - protein, 506 aa, Homo sapiens; identical to SEQ ID NO: 766843

SEQ ID NO: 766846 - protein, 506 aa, Homo sapiens; identical to SEQ ID NO: 766843

SEQ ID NO: 766847 - protein, 506 aa, Homo sapiens; identical to SEQ ID NO: 766843

SEQ ID NO: 766848 - protein, 506 aa, Homo sapiens; identical to SEQ ID NO: 766843

SEQ ID NO: 766849 - protein, 493 aa, Homo sapiens
MSTAAAEVPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766850 - protein, 456 aa, Homo sapiens
PGGTPPGNGIDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766851 - protein, 416 aa, Homo sapiens
MNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766852 - protein, 335 aa, Homo sapiens
CSMPHSSLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766853 - protein, 255 aa, Homo sapiens
AGGALLSQLKMADESETAVKPPAPPLPQMMEGNGNGHEHCSDCENEEDNSYNRGYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766854 - protein, 198 aa, Homo sapiens
TALKWQQRGRKEAVPTCPHLFLFVPAALQKGFDVFNALDLMENKTFLEKVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766855 - protein, 122 aa, Homo sapiens
MTCGVRVSLLPSPLRSYRNEALARRPGSALCHSPKPLSTGQQGLVAGCGFWCGLSEANSAEFPKPEDIVCLGWGPCHPWECCPLCRLLLEPATPLRWIFIRGLQGPPFSHCSCAANCRPQQS

SEQ ID NO: 766856 - protein, 169 aa, Homo sapiens
DLENHLVQAFWSGVQPSDRAKLGCEIVLPGLDVIFALERSKWWEGGSMTCGVRVSLLPSPLRSYRNEALARRPGSALCHSPKPLSTGQQGLVAGCGFWCGLSEANSAEFPKPEDIVCLGWGPCHPWECCPLCRLLLEPATPLRWIFIRGLQGPPFSHCSCAANCRPQQS

SEQ ID NO: 766857 - protein, 432 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNPSPQGNLYIDHTA

SEQ ID NO: 766858 - protein, 383 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPEGQCCPGWWAGGRERARRAWLSAGEKGSGWRGSFLLLEKRTSP

SEQ ID NO: 766859 - protein, 364 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPTATTGVV

SEQ ID NO: 766860 - protein, 403 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPEGQCCPGWWAGGRERARRAWLSAGEKGSGWRGSFLLLEKRTSLSSLRAVLDVSIYLPIRISDV

SEQ ID NO: 766861 - protein, 309 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKSDEPRSQIGPRGQIEPRSQIEPRSQIEPRSQIEPRSQIEPRSPIEP

SEQ ID NO: 766862 - protein, 107 aa, Homo sapiens
ADSRVSLLPAAMFQRRPLPPAFGLTLHLTTDSSLCVGRELSRRPPLRIEACIGLVSPHMPISEEASVLFEGQPTPSYFNTRFMENVRPSPQLLSNCCRPPTCWLSEA

SEQ ID NO: 766863 - protein, 506 aa, Homo sapiens; identical to SEQ ID NO: 766843

SEQ ID NO: 766864 - protein, 422 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKNRYGCLLECPLVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 766865 - protein, 416 aa, Homo sapiens; identical to SEQ ID NO: 766851

SEQ ID NO: 766866 - protein, 416 aa, Homo sapiens; identical to SEQ ID NO: 766851

SEQ ID NO: 766867 - protein, 506 aa, Homo sapiens; identical to SEQ ID NO: 766843

SEQ ID NO: 766868 - protein, 156 aa, Homo sapiens [sequence omitted]

SEQ ID NO: 766869 - protein, 506 aa, Homo sapiens; identical to SEQ ID NO: 766843

SEQ ID NO: 766870 - protein, 504 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGDT

SEQ ID NO: 766871 - protein, 383 aa, Homo sapiens; identical to SEQ ID NO: 766858

SEQ ID NO: 766872 - protein, 348 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGL

SEQ ID NO: 766873 - protein, 305 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCR

SEQ ID NO: 766874 - protein, 254 aa, Homo sapiens
AGGALLSQLKMADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTDDTYVG

SEQ ID NO: 766875 - protein, 88 aa, Homo sapiens
PLSPRSPPLAPAAAGKSRLEEQRRPPSQLSFPFCFCLTILFSSSKDGCLEKGEKLRGRQRGAKEGAIASAGAGGGFSSANPSWTIVSS

SEQ ID NO: 766876 - protein, 587 aa, Homo sapiens
MISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 766877 - protein, 1008 aa, Homo sapiens
MISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 766878 - protein, 1008 aa, Homo sapiens; identical to SEQ ID NO: 766877

SEQ ID NO: 766879 - protein, 333 aa, Homo sapiens [sequence omitted]

SEQ ID NO: 766880 - protein, 333 aa, Homo sapiens [sequence omitted]

SEQ ID NO: 766881 - protein, 333 aa, Homo sapiens [sequence omitted]

SEQ ID NO: 766882 - protein, 559 aa, Homo sapiens
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 766883 - protein, 876 aa, Homo sapiens
MISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVRFISLEPHFYLYLSGNCIA

SEQ ID NO: 766884 - protein, 258 aa, Homo sapiens
LGTRQAIRFNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 766885 - protein, 892 aa, Homo sapiens
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 766886 - protein, 812 aa, Homo sapiens
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAK

SEQ ID NO: 766887 - protein, 88 aa, Homo sapiens; identical to SEQ ID NO: 766875

SEQ ID NO: 766888 - protein, 179 aa, Homo sapiens
ILGTSFFNDLFWFQDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILV

SEQ ID NO: 766889 - protein, 117 aa, Homo sapiens
MVKLSIVLTPQFLSHDQGPLTKELQQHVKSVTCPCEYLRKTILHLPPPMDPLPLCLPVLPMLQWITQHPSQGPMPLKMDLPPGDPGVLPLSCPQECPDPHSYPGPRSLTPGLPSSAV

SEQ ID NO: 766890 - protein, 108 aa, Homo sapiens
KGQGIVCGDSGGSGGSGQPDLVTLLAHQTILHLPPPMDPLPLCLPVLPMLQWITQHPSQGPMPLKMDLPPGDPGVLPLSCPQECPDPHRESVPHRESVPTEERHPTER

SEQ ID NO: 766891 - protein, 856 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766892 - protein, 859 aa, Homo sapiens
GTPPDYGMGPARRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766893 - protein, 494 aa, Homo sapiens
MTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766894 - protein, 538 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGMIS

SEQ ID NO: 766895 - protein, 773 aa, Homo sapiens
MGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766896 - protein, 898 aa, Homo sapiens
GTPPDYGMGPARRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSCLRKKKNLKQRQLNEGSSEESGGGCVLFPSAHQLFSFCSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766897 - protein, 494 aa, Homo sapiens; identical to SEQ ID NO: 766893

SEQ ID NO: 766898 - protein, 592 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVR

SEQ ID NO: 766899 - protein, 538 aa, Homo sapiens; identical to SEQ ID NO: 766894

SEQ ID NO: 766900 - protein, 520 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWVRMAVTPLSFQVPVHHHPTCW

SEQ ID NO: 766901 - protein, 538 aa, Homo sapiens; identical to SEQ ID NO: 766894

SEQ ID NO: 766902 - protein, 832 aa, Homo sapiens
GTPPDYGMGPARRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766903 - protein, 383 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTISPSSGNLCFLRFGAGWSH

SEQ ID NO: 766904 - protein, 637 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGYHMEHFEECWPSTFFQEAWFLLEIFFWRTETWAPDQRTLLPECVNYTTEQAQSNGLRTHTSTEAKDLQPATGKDCHLLAASGTGRLTIFFFQAFNTNKNPII

SEQ ID NO: 766905 - protein, 682 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAAPEGLLLMDTIRCWEAGTTRTWTESPVTGLADRGALSYSITNNGWGYHMEHFEELLAIDIFSRSLVFTGDFFLENRDGTGGSEDPEARKLNYTTEQAQSNGLRTHTSTEAKDLQPATGKDCHLLAASGTGRLTIFFFQAFNTNKNPII

SEQ ID NO: 766906 - protein, 602 aa, Homo sapiens
MAMQNFQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766907 - protein, 573 aa, Homo sapiens [sequence omitted]

SEQ ID NO: 766908 - protein, 586 aa, Homo sapiens
ILGTSFFNDLFWFQDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766909 - protein, 339 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEG

SEQ ID NO: 766910 - protein, 542 aa, Homo sapiens
PLKSSGGWVAKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766911 - protein, 339 aa, Homo sapiens; identical to SEQ ID NO: 766909

SEQ ID NO: 766912 - protein, 339 aa, Homo sapiens; identical to SEQ ID NO: 766909

SEQ ID NO: 766913 - protein, 461 aa, Homo sapiens
MSLKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766914 - protein, 305 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMGFFLVQMIKQSSLFGAMKYSR

SEQ ID NO: 766915 - protein, 272 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQVMWYQVAILKK

SEQ ID NO: 766916 - protein, 142 aa, Homo sapiens
MCGDLEDPTRLLFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVR

SEQ ID NO: 766917 - protein, 494 aa, Homo sapiens; identical to SEQ ID NO: 766893

SEQ ID NO: 766918 - protein, 449 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILV

SEQ ID NO: 766919 - protein, 494 aa, Homo sapiens; identical to SEQ ID NO: 766893

SEQ ID NO: 766920 - protein, 339 aa, Homo sapiens; identical to SEQ ID NO: 766909

SEQ ID NO: 766921 - protein, 376 aa, Homo sapiens
MTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766922 - protein, 272 aa, Homo sapiens; identical to SEQ ID NO: 766915

SEQ ID NO: 766923 - protein, 277 aa, Homo sapiens
QERYGAPPRRLSTIRFGSRRRRLAAPPLLRPAGRGRGGRQRCQRGRSCGAREEEVEPGTARPPPAASAMDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCLSQ

SEQ ID NO: 766924 - protein, 383 aa, Homo sapiens
FELRYPLPSLTLIQPGTLLKSVEARWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 766925 - protein, 104 aa, Homo sapiens
SHLNGTPSFWNKPAVFLPHGLALGFLCMESLSHGYLYGLLPHRFRFLSNVTFFVRPSLADFIKTATLSSWSLLYFSPKNYCHLKNYIVYLFICIQNTSSTRPGI

SEQ ID NO: 766926 - protein, 1226 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766927 - protein, 1226 aa, Homo sapiens; identical to SEQ ID NO: 766926

SEQ ID NO: 766928 - protein, 931 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766929 - protein, 1200 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766930 - protein, 121 aa, Homo sapiens
MVGVYVMSDAERSGRRIVREPRSLSHRRAYAAVGYTTDNPRKRVIVCPPGPLENSLKERGPHNKLGPHAQRKMGAPLSNESSQEGPSCVPRQRDCVYKRGGPWPLGLIIIRDRPYKGGPPW

SEQ ID NO: 766931 - protein, 1245 aa, Homo sapiens
GGEGSRPHWQPPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766932 - protein, 1219 aa, Homo sapiens
GGEGSRPHWQPPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766933 - protein, 931 aa, Homo sapiens; identical to SEQ ID NO: 766928

SEQ ID NO: 766934 - protein, 567 aa, Homo sapiens
DEDPSNRRFSSKWFVYQAKVGGRWFPAVCAHSKKQGKQEAADAALRVLIGENEKAERMGFTEVTPVTGASLRRTMLLLSRSPEAQPKTVKTSTFGAFFGGGGSSYTPKWRWLLLSCELFLGFTLSLERAVTGTLDVRRKRRLTRQVELDLPAHGEYGGHSLSFVVLTQPLFPTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766935 - protein, 412 aa, Homo sapiens
SSVPPRLARQSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766936 - protein, 246 aa, Homo sapiens [sequence omitted]

SEQ ID NO: 766937 - protein, 1245 aa, Homo sapiens; identical to SEQ ID NO: 766931

SEQ ID NO: 766938 - protein, 122 aa, Homo sapiens
MPLQNTKASQGTGREVAPVSWSGRGLLPGSGSAGGTVNQSWHPHPGQRGLWFSASEGSAAPLLFRLQGCHLLSPQVVWPLWSILGIRFSSRALASCLFFNWEHRLSQDQNPHSPPRSYLASL

SEQ ID NO: 766939 - protein, 1245 aa, Homo sapiens; identical to SEQ ID NO: 766931

SEQ ID NO: 766940 - protein, 1245 aa, Homo sapiens; identical to SEQ ID NO: 766931

SEQ ID NO: 766941 - protein, 1245 aa, Homo sapiens; identical to SEQ ID NO: 766931

SEQ ID NO: 766942 - protein, 1245 aa, Homo sapiens; identical to SEQ ID NO: 766931

SEQ ID NO: 766943 - protein, 1245 aa, Homo sapiens; identical to SEQ ID NO: 766931

SEQ ID NO: 766944 - protein, 1245 aa, Homo sapiens; identical to SEQ ID NO: 766931

SEQ ID NO: 766945 - protein, 971 aa, Homo sapiens
GGEGSRPHWQPPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISRSVWRCALLHPLSPDR

SEQ ID NO: 766946 - protein, 1181 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766947 - protein, 931 aa, Homo sapiens; identical to SEQ ID NO: 766928

SEQ ID NO: 766948 - protein, 1330 aa, Homo sapiens
GGEGSRPHWQPPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTVKTSTFGAFFGGGGSSYTPKWRWLLLSCELFLGFTLSLERAVTGTLDVRRKRRLTRQVELDLPAHGEYGGHSLSFVVLTQPLFPTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766949 - protein, 1343 aa, Homo sapiens
GGEGSRPHWQPPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYIRSVQFLLLPGWALPGCLELGIQMLSWPVNRTWYNKPHSTVGLRSIFRRRSLTCTAVHLQSPMVGLRKHPLPLSHLTVLEPHEIADFPQVSFNSHPMFFSTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766950 - protein, 468 aa, Homo sapiens
GGEGSRPHWQPPGVRPCPEEVQDPGYSLSGYYTHPFQGYEHRQLRYQQPGPGSSPSSFLLKQIEFLKGQLPEAPLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 766951 - protein, 1245 aa, Homo sapiens; identical to SEQ ID NO: 766931

SEQ ID NO: 766952 - protein, 75 aa, Homo sapiens
SKAVRPELGIFLLFKKLCSFRYRRDLLRLSYGEAKKAARDYETAKNYFKKGLKDMGYGNWISKPQEEKNFYLCPV

SEQ ID NO: 766953 - protein, 1245 aa, Homo sapiens; identical to SEQ ID NO: 766931

SEQ ID NO: 766954 - protein, 122 aa, Homo sapiens; identical to SEQ ID NO: 766938

SEQ ID NO: 766955 - protein, 122 aa, Homo sapiens; identical to SEQ ID NO: 766938

SEQ ID NO: 766956 - protein, 1245 aa, Homo sapiens; identical to SEQ ID NO: 766931

SEQ ID NO: 766957 - protein, 1245 aa, Homo sapiens; identical to SEQ ID NO: 766931

SEQ ID NO: 766958 - protein, 103 aa, Homo sapiens
MRCDCTEVMCSRKLPVVEDGSLAEARSGSSVKTILILLRASSPVRFQYCVAVGAQTFPSVSAPSKKVAKQMAAEEAMKALHGEATNSMASDNQVGRFPTQKIQ

SEQ ID NO: 766959 - protein, 121 aa, Homo sapiens
CCDLAVNSMGLFFNSGPYPVIKYEIRMCCEALDWLEACPHTYLIKSLKEHGQKINQGQENLQSRRQHGPLVSDRADLEYRATQPIIGARRSALPAALRNTRLRDSDPSLGLGGASGSGQHR

SEQ ID NO: 766960 - protein, 449 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 766961 - protein, 448 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 766962 - protein, 176 aa, Homo sapiens
PFDLLSFVRCCVCGASAVGVSLVSWSGLFWVVGRWSAGGSVVSRSVLWWGVVRFAGVSLWSVVGAARVAVLIVAIGNVPRILLRQVQIAWCMRALAAHSRVTWIPGAGLADGTLDSADSVALVPIWSLPANQSSYGGPASQQLSGGYGGGYGGQSSMSGYDQVLQENSSDFQSNIA

SEQ ID NO: 766963 - protein, 448 aa, Homo sapiens; identical to SEQ ID NO: 766961

SEQ ID NO: 766964 - protein, 448 aa, Homo sapiens; identical to SEQ ID NO: 766961

SEQ ID NO: 766965 - protein, 176 aa, Homo sapiens; identical to SEQ ID NO: 766962

SEQ ID NO: 766966 - protein, 448 aa, Homo sapiens; identical to SEQ ID NO: 766961

SEQ ID NO: 766967 - protein, 437 aa, Homo sapiens
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 766968 - protein, 404 aa, Homo sapiens
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 766969 - protein, 437 aa, Homo sapiens; identical to SEQ ID NO: 766967

SEQ ID NO: 766970 - protein, 437 aa, Homo sapiens; identical to SEQ ID NO: 766967

SEQ ID NO: 766971 - protein, 437 aa, Homo sapiens; identical to SEQ ID NO: 766967

SEQ ID NO: 766972 - protein, 404 aa, Homo sapiens; identical to SEQ ID NO: 766968

SEQ ID NO: 766973 - protein, 404 aa, Homo sapiens; identical to SEQ ID NO: 766968

SEQ ID NO: 766974 - protein, 243 aa, Homo sapiens
MEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 766975 - protein, 243 aa, Homo sapiens; identical to SEQ ID NO: 766974

SEQ ID NO: 766976 - protein, 419 aa, Homo sapiens
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMVSGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 766977 - protein, 330 aa, Homo sapiens
MVDGTLLLLLSEALALTQTWAGSHSLKYFHTSVSRPGRGEPRFISVGYVDDTQFVRFDNDAASPRMVPRAPWMSRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 766978 - protein, 437 aa, Homo sapiens; identical to SEQ ID NO: 766967

SEQ ID NO: 766979 - protein, 282 aa, Homo sapiens
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGEFISGEEINRTILWWNHARARP

SEQ ID NO: 766980 - protein, 75 aa, Homo sapiens
ARSQAPCERIATHAAAWREGAGVLRQSRRRRGAAAGEEQPLPPRTGPLGRRRREDGGRPQCCRQERGDLEDQEAH

SEQ ID NO: 766981 - protein, 437 aa, Homo sapiens; identical to SEQ ID NO: 766967

SEQ ID NO: 766982 - protein, 437 aa, Homo sapiens; identical to SEQ ID NO: 766967

SEQ ID NO: 766983 - protein, 243 aa, Homo sapiens; identical to SEQ ID NO: 766974

SEQ ID NO: 766984 - protein, 96 aa, Homo sapiens
VVLEDPERTIARPPPDWQFQGCKLHCKIKLTHEAFGPVHCLLPSVCRHICARRLGALCINVLTRVPITLTYSKPVWDGYDGASVLLLGLGEIKHAI

SEQ ID NO: 766985 - protein, 248 aa, Homo sapiens [sequence omitted]

SEQ ID NO: 766986 - protein, 1089 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 766987 - protein, 1089 aa, Homo sapiens; identical to SEQ ID NO: 766986

SEQ ID NO: 766988 - protein, 218 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 766989 - protein, 186 aa, Homo sapiens
MKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLGWAGGVGTRCQRNLSHAQAQALLAGRPLLSGLP

SEQ ID NO: 766990 - protein, 872 aa, Homo sapiens
MEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 766991 - protein, 1089 aa, Homo sapiens; identical to SEQ ID NO: 766986

SEQ ID NO: 766992 - protein, 1089 aa, Homo sapiens; identical to SEQ ID NO: 766986

SEQ ID NO: 766993 - protein, 1089 aa, Homo sapiens; identical to SEQ ID NO: 766986

SEQ ID NO: 766994 - protein, 1089 aa, Homo sapiens; identical to SEQ ID NO: 766986

SEQ ID NO: 766995 - protein, 807 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLGWAGGVGTRCQRNLSHAQAQALLAGRPLLSGLP

SEQ ID NO: 766996 - protein, 790 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLGKSVYTHSGCWDFPVV

SEQ ID NO: 766997 - protein, 674 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGGLTDLE

SEQ ID NO: 766998 - protein, 1827 aa, Homo sapiens [sequence omitted]

SEQ ID NO: 766999 - protein, 1827 aa, Homo sapiens [sequence omitted]

SEQ ID NO: 767000 - protein, 233 aa, Homo sapiens
CYLATTQVEARLCAVEEDTFEVYLYVTIKDEKVCVNDDLVAKNYACYMSPTKNKNLDYLEKPRLNIKSAPSFNKLNPALTLWPMFLQGKDVQGMEDSHGVNFPAQSLQHTWCKGIVGDLRPTATAQDKAVKCNMDSLRDSPKDKSEKKHHCISLKDTNKRVESSVYWPAKRGITIYADPDVPEASALSQKSNEKPLRLTEKKEYDEKNSCVKLLQFLNPDPLRADGISDLQQT

SEQ ID NO: 767001 - protein, 220 aa, Homo sapiens
MLGLPGPSLQPSLASSACGTCSRLRLKMPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 767002 - protein, 174 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPRRGPLAPRPVLPHASPRV

SEQ ID NO: 767003 - protein, 90 aa, Homo sapiens
MPRSCCSRSGALLLALLLQASMEVRGWCLESSQCQDLTTESNLLECIRACKPDLSAETPMFPGNGDEQPLTENPRSALRPGKPVRPERRS

SEQ ID NO: 767004 - protein, 267 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 767005 - protein, 267 aa, Homo sapiens; identical to SEQ ID NO: 767004

SEQ ID NO: 767006 - protein, 267 aa, Homo sapiens; identical to SEQ ID NO: 767004

SEQ ID NO: 767007 - protein, 267 aa, Homo sapiens; identical to SEQ ID NO: 767004

SEQ ID NO: 767008 - protein, 453 aa, Homo sapiens
HLGPAPEALRAWPLSRVPPPSTPEQRARSGRSRSLGLCLSPMAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 767009 - protein, 288 aa, Homo sapiens
HLGPAPEALRAWPLSRVPPPSTPEQRARSGRSRSLGLCLSPMAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNVSPLPGPWDTRVEGGSRELGRPLASAPSPDLSGDVTGLGPTAVGPWTEQALRVQARTVGRMRLGLGPRNRSPLSSKSLYLGPILKFGSKEQKQAWVTPFTSGDKIGCFALSEPGTCPVPSPVLRVTG

SEQ ID NO: 767010 - protein, 127 aa, Homo sapiens
SLVHDGLLKPCMSPYNTVRKPDGSYWLVQDLRAINQIVQTTHTVVPNPYTNVSRIPHNHQRFTVVDLKDAFCACLLAEDSQDMFACEWEDPHSGQKQQYQWTVLPQGFTKSPNLFGQILEQVLETSP

SEQ ID NO: 767011 - protein, 102 aa, Homo sapiens
MPRRESPQEKAPEDLKEKKEKVEEKASRKERKKEVVEAPVPLVVMVGKACSQPEATPSPGPHRRRRTGLRRKKKKLPRMERRKMKGKKKMRKKKKRMMKGPR

SEQ ID NO: 767012 - protein, 117 aa, Homo sapiens
MKRIPNGRRQKMGHRREPLPTGWGWEASLGLEVGVGAAKSSHSSPGSLLWALHQSCHPLLSPQPSHFRLSRHCALHPHSAIVPPPDLLHLSSPAGPQLLLSLFALFLPPLPASFFLR

SEQ ID NO: 767013 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLTLGVLSLLLLVTGAFGFHLWRRQWRPRRFSALEQGIHPPQAQSKIEELEQEPEPEPEPEPEPEPEPEPEQL

SEQ ID NO: 767014 - protein, 282 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767015 - protein, 102 aa, Homo sapiens
MSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767016 - protein, 282 aa, Homo sapiens; identical to SEQ ID NO: 767014

SEQ ID NO: 767017 - protein, 282 aa, Homo sapiens; identical to SEQ ID NO: 767014

SEQ ID NO: 767018 - protein, 282 aa, Homo sapiens; identical to SEQ ID NO: 767014

SEQ ID NO: 767019 - protein, 282 aa, Homo sapiens; identical to SEQ ID NO: 767014

SEQ ID NO: 767020 - protein, 282 aa, Homo sapiens; identical to SEQ ID NO: 767014

SEQ ID NO: 767021 - protein, 284 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEAPVPLVVMVGKACSQPEATPSPGPHRRRRTGLRRKKKKLPRMERRKMKGKKKMRKKKKRMMKGPR

SEQ ID NO: 767022 - protein, 208 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPAPGPGTMSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767023 - protein, 181 aa, Homo sapiens
TRRGRGGLLSSPLPPAPPLGSPSRRAAPPYKRVPFPGAAAAGRRQLCWCGGGEPGIELPRPSAPATACTALPPAPGPGTMSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767024 - protein, 117 aa, Homo sapiens; identical to SEQ ID NO: 767012

SEQ ID NO: 767025 - protein, 122 aa, Homo sapiens
MTAEEMKATESGAQSAPLPMEGVDISPKQDEGVLKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767026 - protein, 134 aa, Homo sapiens
VLRCSVWPSRGLRIRETQMERNKDLQKLKGKLGGMPRRESPQEKAPEDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 767027 - protein, 441 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEEEENGAEEEEEETAEDGEEEDEGEEEDEEEEEEDDEGPALKRAAEEEVWAGLLGLRGCQGCSRAGRPLDLDPDPCVAGVGAGTGPGQGEVSSSHFTAPPFSPSPQMKRIPNGRRQKMGHRREPLPTGWGWEASLGLEVGVGAAKSSHSSPGSLLWALHQSCHPLLSPQPSHFRLSRHCALHPHSAIVPPPDLLHLSSPAGPQLLLSLFALFLPPLPASFFLR

SEQ ID NO: 767028 - protein, 117 aa, Homo sapiens; identical to SEQ ID NO: 767012

SEQ ID NO: 767029 - protein, 282 aa, Homo sapiens; identical to SEQ ID NO: 767014

SEQ ID NO: 767030 - protein, 282 aa, Homo sapiens; identical to SEQ ID NO: 767014

SEQ ID NO: 767031 - protein, 282 aa, Homo sapiens; identical to SEQ ID NO: 767014

SEQ ID NO: 767032 - protein, 162 aa, Homo sapiens
MQPGWAPFGFGPRSLCGRGGGWNRTGTGGGLPSHFTAPPFSPSPQMKRIPNGRRQKMGHRREPLPTGWGWEASLGLEVGVGAAKSSHSSPGSLLWALHQSCHPLLSPQPSHFRLSRHCALHPHSAIVPPPDLLHLSSPAGPQLLLSLFALFLPPLPASFFLR

SEQ ID NO: 767033 - protein, 147 aa, Homo sapiens
MPGGVEWPGGVEWPGGVEWPALKKELPKKGMKRIPNGRRQKMGHRREPLPTGWGWEASLGLEVGVGAAKSSHSSPGSLLWALHQSCHPLLSPQPSHFRLSRHCALHPHSAIVPPPDLLHLSSPAGPQLLLSLFALFLPPLPASFFLR

SEQ ID NO: 767034 - protein, 258 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEEEENGAEEEEEETAEDGEEEDEGEEEDEEEEEEDETCSI

SEQ ID NO: 767035 - protein, 322 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEEEENGAEEEEEETAEDGEEEDEGEEEDEEEEEEDDEGPALKRAAEEEMKRIPNGRRQFGLEVGVGAAKSSHSSPGSLLWALHQSCHPLLSPQPSHFRLPFLFV

SEQ ID NO: 767036 - protein, 238 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVEEEENGAEEEEEEICHCSTS

SEQ ID NO: 767037 - protein, 103 aa, Homo sapiens
MAEARGSSSLDSFFLNFGAYTVRAKSSHSSPGSLLWALHQSCHPLLSPQPSHFRLSRHCALHPHSAIVPPPDLLHLSSPAGPQLLLSLFALFLPPLPASFFLR

SEQ ID NO: 767038 - protein, 238 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKDLKEKKEKVEEKASRKERKKEVVECGKKVRFTPMNMIVKWILA

SEQ ID NO: 767039 - protein, 169 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPR

SEQ ID NO: 767040 - protein, 196 aa, Homo sapiens
PPGLVLPPDSLALPPLAFILLSPPLQPPLSSPSPLLSSPLPPAPPLGSPSRRAAPPYKRVPFPGAAAAGRRQLCWCGGGEPGIELPRPSAPATACTALPPALRTAAALRVSAPDPPPPHPARLCRLFQRPSLPSGRRCRCRRRRRHRARFRPRPPSAVQGPSVSAPGPRLPASPGPGPGTMSEKSVEAAAELSAKT

SEQ ID NO: 767041 - protein, 95 aa, Homo sapiens
SPGPIPLGRGGYRGRGGFQGRGGDPKSGDWVCPNPSCGNMNFARRNSCNQCNEPRPEDSRPSGGDFRGRGYGGERGYRGRGGRGGDRGGYGGSGG

SEQ ID NO: 767042 - protein, 592 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767043 - protein, 628 aa, Homo sapiens
GGRSGIPGYSSGRRAAWLSYSLFSAGCGASAPRPLVMSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767044 - protein, 501 aa, Homo sapiens
MESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767045 - protein, 592 aa, Homo sapiens; identical to SEQ ID NO: 767042

SEQ ID NO: 767046 - protein, 202 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSR

SEQ ID NO: 767047 - protein, 525 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767048 - protein, 583 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGSFPL

SEQ ID NO: 767049 - protein, 501 aa, Homo sapiens; identical to SEQ ID NO: 767044

SEQ ID NO: 767050 - protein, 202 aa, Homo sapiens; identical to SEQ ID NO: 767046

SEQ ID NO: 767051 - protein, 501 aa, Homo sapiens; identical to SEQ ID NO: 767044

SEQ ID NO: 767052 - protein, 501 aa, Homo sapiens; identical to SEQ ID NO: 767044

SEQ ID NO: 767053 - protein, 425 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGEAAQA

SEQ ID NO: 767054 - protein, 202 aa, Homo sapiens; identical to SEQ ID NO: 767046

SEQ ID NO: 767055 - protein, 395 aa, Homo sapiens
MTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767056 - protein, 323 aa, Homo sapiens
MINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 767057 - protein, 323 aa, Homo sapiens; identical to SEQ ID NO: 767056

SEQ ID NO: 767058 - protein, 220 aa, Homo sapiens
EWGVGASRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRSRGGYGGDRGGGSGYGGDRSGGYGGDRSGGGYGGDRGGGYGGDRGGYGGKMGGRNDYRNDQRNRPY

SEQ ID NO: 767059 - protein, 194 aa, Homo sapiens
MEIQAAKAMDKHHKAILAMGKRLIPLMDRTTAVTPVMDKVSQVIHSPMVVMRIKSRAHIASNHIITRDSSKTWNHQEAKVEEHLPMTSQTMVNKIHMTSSQAMINIKAHMMSSQIMISSMIPIVKTSSPIIHKGKTTATTHKMMPCVQAQYSPSPPGSSYAAQTYSSEYTTEIMNPDYTKLTMDLGSTEITATA

SEQ ID NO: 767060 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGKPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 767061 - protein, 1838 aa, Homo sapiens; identical to SEQ ID NO: 767060

SEQ ID NO: 767062 - protein, 1838 aa, Homo sapiens; identical to SEQ ID NO: 767060

SEQ ID NO: 767063 - protein, 1838 aa, Homo sapiens; identical to SEQ ID NO: 767060

SEQ ID NO: 767064 - protein, 1838 aa, Homo sapiens; identical to SEQ ID NO: 767060

SEQ ID NO: 767065 - protein, 1838 aa, Homo sapiens; identical to SEQ ID NO: 767060

SEQ ID NO: 767066 - protein, 1838 aa, Homo sapiens; identical to SEQ ID NO: 767060

SEQ ID NO: 767067 - protein, 1838 aa, Homo sapiens; identical to SEQ ID NO: 767060

SEQ ID NO: 767068 - protein, 386 aa, Homo sapiens
MAVLRANWPTVAEHETWLPQMPLPVFIFPQGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 767069 - protein, 86 aa, Homo sapiens
SWYAGFGYVDHALLAFNHARKPSLSPTDRMGEAWILGCSTVLIRNRKSPHPRPGQERAINWKFAPGQQEFMLPLKSRYQCPFSDSF

SEQ ID NO: 767070 - protein, 142 aa, Homo sapiens [sequence omitted]

SEQ ID NO: 767071 - protein, 1352 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGKPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPPFKVVIICTELQNVSRSPQTTLATVYCNKITSYICRKIFWCNFIFSSQYI

SEQ ID NO: 767072 - protein, 107 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPGPCLQPPSSPDPSCS

SEQ ID NO: 767073 - protein, 1838 aa, Homo sapiens; identical to SEQ ID NO: 767060

SEQ ID NO: 767074 - protein, 253 aa, Homo sapiens
MAWTRDAERAGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 767075 - protein, 142 aa, Homo sapiens [sequence omitted]

SEQ ID NO: 767076 - protein, 281 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDLSPSSLQKKSHSRGLSRDPRGLRLGHVILFSFLIPSNLSFSPVIFFLCGPFKVVIICTELQNVSRSPQTTLATVYCNKITSYICRKIFWCNFIFSSQYI

SEQ ID NO: 767077 - protein, 38 aa, Homo sapiens
MTFLRLLSASAHQNVTYHCYQSVAWQDAATGSYDKALR

SEQ ID NO: 767078 - protein, 285 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 767079 - protein, 196 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAEKDNRDQAWVDAQRRGYHGLGPQRSRQQQPVPNSDAVLNCPACMTTLCLDCQRQTVAEWINKQDSTICCLEETCFTCKD

SEQ ID NO: 767080 - protein, 143 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVLVTKKKRTIHPRIPTFDDLLFAPGL

SEQ ID NO: 767081 - protein, 84 aa, Homo sapiens
KSPVTVGSLTGESESSSEDEFEKEMEAELNSTMKTMEDKLSSLGTGSSSGNGKVATAPTRYYDDIYFDSDSEDEDRAVSNLFTR

SEQ ID NO: 767082 - protein, 82 aa, Homo sapiens
YYYGVGGRSPLTGESESSSEDEFEKEMEAELNSTMKTMEDKLSSLGTGSSSGNGKVATAPTRYYDDIYFDSSSSESESVDAA

SEQ ID NO: 767083 - protein, 285 aa, Homo sapiens; identical to SEQ ID NO: 767078

SEQ ID NO: 767084 - protein, 221 aa, Homo sapiens
MEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 767085 - protein, 264 aa, Homo sapiens [sequence omitted]

SEQ ID NO: 767086 - protein, 217 aa, Homo sapiens
MRSPHNEKWRTVISLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 767087 - protein, 139 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVTMVWDHRDHVNNSLFQIVMLS

SEQ ID NO: 767088 - protein, 267 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKAETDVEEIYHPVMCTECSTEVAVYDKDEVFHFFNVLASHS

SEQ ID NO: 767089 - protein, 285 aa, Homo sapiens; identical to SEQ ID NO: 767078

SEQ ID NO: 767090 - protein, 1132 aa, Homo sapiens
VLSYLISESPMEPSEVPSQISKDNFLEVPNLSDSLCEDEEVTFQPGFSPQPSRRGSDSSEDIYLDTPSSGTRRVSFADSFGFNLVSVKEFDCWELPSASTTFDLGTDIFHTEEYVLAPLFDLPSSKEDLMQQLQIQKAILESTESLLGSTSIKGIIRVLNVSFEKLVYVRMSLDDWQTHYDILAEYVPNSCDGETDQFSFKIVLVPPYQKDGSKVEFCIRYETSVGTFWSNNNGTNYTFICQKKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDHRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 767091 - protein, 921 aa, Homo sapiens
MKKLLSNLVSPLNQVDEVLILLKTYTWIPHLQKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDHRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 767092 - protein, 583 aa, Homo sapiens
MKKLLSNLVSPLNQVDEVLILLKTYTWIPHLQKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFSLEGSFKKGRE

SEQ ID NO: 767093 - protein, 883 aa, Homo sapiens
MSGALANSLITSRENLGKNDSGKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDHRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 767094 - protein, 147 aa, Homo sapiens
SHYNAVFTHNHHHKKLKGRESRHLAQAHFKLLSTSDPSSWRPELLGLKAQWLISVRPATWKIEEGVSLESRSSDQIEQYKETPSQNKINKKKFNLYLWETGFHHIGQAGLELLTSSDPPALTSRSSGITTVNHCTRPISYLNDGEIL

SEQ ID NO: 767095 - protein, 119 aa, Homo sapiens
MNKILSSTVCFGLLTLLSVLIFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 767096 - protein, 208 aa, Homo sapiens
VEEKHASLERVEQEQRWTGMSHDGAAGRAPLSSVLQNCRALPLPSAQKHSPHQAAAAGGWRDGVSDSRLFFLPVQHFFQRYEVKSRPSSHLVGSTVQVRGDAALHSPDWTPSPWNSQHTGEAERSKRTEKHKKIQPCHLVQILTVPRRKRGTQRSPAAGIQEELRCSRPTTSLPANSKLTVLLPCSQKWHWMDPIQVSPGCHFLPFCT

SEQ ID NO: 767097 - protein, 181 aa, Homo sapiens
TWRKSTRVWSGWSRNRGGLECHTTGQLEVHKNTLHTKLLLLGDGGMASAIQDCFSYLFSTSFSDMKLNPAHRSLSEEEPPLRSCTQGDSATARPTAHFEIMVLEPDVVIGCFGKVLTVPRRKRGTQRSPAAGIQEELRCSRPTTSLPANSKLTVLLPCSQKWHWMDPIQVSPGCHFLPFCT

SEQ ID NO: 767098 - protein, 171 aa, Homo sapiens
VEEKHASLERVEQEQRWTGMSHDGAAGRAPLSSVLQNCRALPLPSAQKHSPHQAAAAGGWRDGVSDSRLFFLPVQHFFQRYEVKSRPSSHLVGSTVQVRGDAALHSPDWTPSPWNSQHTGEAERSKRTEKHKKIQPCHLVQKSHRLECSGMISAPHNLCLRCSSDSPVSAC

SEQ ID NO: 767099 - protein, 113 aa, Homo sapiens
MASAIQDCFSYLFSTSFSDMKLNPDVVIIHLFKQEPKDHPRFLLTSSQSIPETAKPPAKFPPGGKHCAGSWGCSPAQPRLDSFPMELTTHGRGREIQAHRKTQEDSALSSCAK

SEQ ID NO: 767100 - protein, 170 aa, Homo sapiens
VEEKHASLERVEQEQRWTGMSHDGAAGRAPLSSVLQNCRALPLPSAQKHSPHQAAAAGGWRDGVSDSRLFFLPVQHFFQRYEVKSSVSASSPSTYSHTPGLPIFNINGLSWTPLPTSVTATLPEKEVYTLHSLSFTHFQPGSCYHWTVKSDSCQSHYSGYLLLCNNLLKI

SEQ ID NO: 767101 - protein, 142 aa, Homo sapiens
VEEKHASLERVEQEQRWTGMSHDGAAGRAPLSSVLQNCRALPLPSAQKHSPHQAAAAGGWRDGVSDSRLFFLPVQHFFQRYEVKSRPSSHLVGSTVQVRGDAALHSPDWTPSPWNSQHTGEAERSKRTEKHKKIQPCHLVQR

SEQ ID NO: 767102 - protein, 101 aa, Homo sapiens
VEEKHASLERVEQEQRWTGMSHDGAAGRAPLSSVLQNCRALPLPSAQKHSPHQAAAAGGWRDGVSDSRLFFLPVQHFFQRYEVKSRCRHHPLVQTRAQGSS

SEQ ID NO: 767103 - protein, 122 aa, Homo sapiens
MNYCMQEIYEVHPAAGSNCYMQSTDYYAYFEDSPGYSGCDAQAVPSNNIYMEQAWAVNQPYTCSYPGNMFKSKDSDLDMALNQYSQPEYFTEEKPTFSQVQSPSYSQKKGYIPSYLDKDELC

SEQ ID NO: 767104 - protein, 116 aa, Homo sapiens [sequence omitted]

SEQ ID NO: 767105 - protein, 110 aa, Homo sapiens
TCRPSRRCTLALSAQPTRGRRAGRAESGRGGGAARKACLAQALRPSDSSGPWRPGSCTFTWRLGAFFSAACGWMCMVWPGESLELHEHLKTERGNGSGGGHTQCRVDTVP

SEQ ID NO: 767106 - protein, 117 aa, Homo sapiens
PAAPAAAVHWRLALSRPEGAGLGGRSRAVGRGREEGLPSPGPPPIRLFRPLEAWLLYLHLASWRLFLSGLWVDVHGVAWRECRTPPPSSLELHEHLKTERGNGSGGGHTQCRVDTVP

SEQ ID NO: 767107 - protein, 981 aa, Homo sapiens
GWIPPLSRFPIDIFFTPKQEGDVNFNLICNVEKKVHPVTLNVKAEGYTMNVEIKCKDRTGSITLLTPNQTNIINFYEVELNECVQCEFNFINTGKFTFSFQAQLCGSKTLLQYLEFSPIDSTVDVGQSVHATLSFQPLKKCVLTDLELIIKISHGPTFMCNISGCAVSPAIHFSFTSYNFGTCFIYQAGMPPYKQTLVITNKEETPMSIDCLYTNTTHLEVNSRVDVVKPGNTLEIPITFYPRESINYQELIPFEINGLSQQTVEIKGKGTKMKILVLDPANRIVKLGAVLPGQVVKRTVSIMNNSLAQLTFNQSILFTIPELQEPKVLTLAPFHNITLKPKEVCKLEVIFAPKKRVPPFSEEVFMECMGLLRPLFLLSGCCQALEISLDQEHIPFGPVVYQTQATRRILMMNTGDVGARFKWDIKKFEPHFSISPEEGYITSGMEVSFEVTYHPTEVGKESLCKNILCYIQGGSPLSLTLSGVCVGPPAVKEVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRFRVIVEILKPEKPDLSITMKGLDYIDVLSGSKKDYKLNFFSHKEGTYAAKVIFRNEVTNEFLYYNVSFRVIPSGIIKTIEMVTPVRQVASASIKLENPLPYSVTFSTECRMPDIALPSQFVVPANSEGTFSFEFQPLKAGETFGRLTLHNTDLGYYQYELYLKATPALPEKPVHFQTVLGSSQIILVKFINYTRQRTEYYCRTDCTDFHAEKLINAAPGGQGGTEASVEVLFEPSHLGETKGILILSSLAGGEYIIPLFGMALPPKPQGPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 767108 - protein, 152 aa, Homo sapiens
GALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHV

SEQ ID NO: 767109 - protein, 136 aa, Homo sapiens
GALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIADLIQSGKCGCISFKDW

SEQ ID NO: 767110 - protein, 419 aa, Homo sapiens
MVEADHPGKLFIGGLNRETNEKMLKAVFGKHGPISEVLLIKDRTSKSRGFAFITFENPADAKNAAKDMNGTSLHGKAIKVEQAKKPSFQSGGRRRPPASSRNRSPSGSLRSARGSSGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNHRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRDLSWCTTCKRASDVLWWKHLPRI

SEQ ID NO: 767111 - protein, 89 aa, Homo sapiens
SKSQLSNTEPPEPEIQVPAHKGSVNTLMCLFLLDKDVIARTRPLPWETQHWTSQALPTPEHAMEPQLVMEPKAVNSGTFETPQQACLLT

SEQ ID NO: 767112 - protein, 255 aa, Homo sapiens
DISAPPIAHPLKEHINEEIRSVLRQDFSSKMKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGLTKMWLT

SEQ ID NO: 767113 - protein, 612 aa, Homo sapiens
DISAPPIAHPLKEHINEEIRSVLRQDFSSKMKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKGSISIQTEEKIHGKSQNQVTIPSQDQEHGHKENKMSYQSSSTEERRLNYGGKSTQKDVSQSSISFQIEKLVEGKSQIQTPNPNQDQWSGQNAKGKSGQSADSKQDLLSHEQKGRYKQESSESHNIVITEHEVAQDDHLTQQYNEDRNPIST

SEQ ID NO: 767114 - protein, 510 aa, Homo sapiens
DISAPPIAHPLKEHINEEIRSVLRQDFSSKMKSIILFVLSLLLILEKQAAVMGQKGGSKGQLPSGSSQFPHGQKGQHYFGQKDQQHTKSKGSFSIQHTYHVDINDHDWTRKSQQYDLNALHKATKSKQHLGGSQQLLNYKQEGRDHDKSKGHFHMIVIHHKGGQAHHGTQNPSQDQGNSPSGKGLSSQCSNTEKRLWVHGLSKEQASASGAQKGRTQGGSQSSYVLQTEELVVNKQQRETKNSHQNKGHYQNVVDVREEHSSKLQTSLHPAHQDRLQHGPKDIFTTQDELLVYNKNQHQTKNLSQDQEHGRKAHKISYPSSRTEERQLHHGEKSVQKDVSKGSISIQTEEKIHGKSQNQVTIHSQDQEHGHKENKISYQSSSTEERHLNCGEKGIQKGVSKGSISIQTEEQIHGKSQNQVRIPSQAQEYGHKENKISYQSSSTEERRLNSGEKDVQKGVSKAVLPTWKNIGRQTRKFLQTRRQETVSISGNATGTESPDPKKAHTKGKRK

SEQ ID NO: 767115 - protein, 116 aa, Homo sapiens
DISAPPIAHPLKEHINEEIRSVLRQDFSSKMKSIILFVLSLLLILEKQAAVMGQKGGSKGQLPSGSSQFPHGQKGQHYFGQKDQQHTKSKGSFSIQHTYHVDINVQTQKKGYGFMD

SEQ ID NO: 767116 - protein, 612 aa, Homo sapiens; identical to SEQ ID NO: 767113

SEQ ID NO: 767117 - protein, 612 aa, Homo sapiens; identical to SEQ ID NO: 767113

SEQ ID NO: 767118 - protein, 1579 aa, Homo sapiens
MAAMTICTAQWLKHHLYQQVQMNPAGPGSGGAGGHAPSRLAGRTSLPPPVSPSLSSRLLLRLQGQGVASALSASASASHLTWLLSMSVSLCQPPEKDTCDYIRAHPFNPGEPLHFMIFSKLASAQTPFPYKGTHSLVPGLRTLLQVPPPMMLCLPETCPLQLGLDPKPAGDLNFTGLSPWTVCSTMQFLGLNVISLGQDLEPAAHTRPPAVSQAMPWVDREVLNPSSGPLVCLATMLLTLLHLQTLRCHVRQGWGGAEGVALVPGFRMKYQSDATAHPGDMLTPNPRVRDPGLVWSLMWSPQSLRYIQKVLAMNGGAESCRASGLGWCPQEMEGLVDALLPQSWGSCLPGVGLWAQREALELQLRGMRGFVDCVLVHVVHVSPPPRRGSSVCTSPTSVLSAGPGRLSSHSMPAPLQPAGPQVLCEGPPRPSAEVEYAPSRQVASSLPVSDTSDEMDPSTQAILRAQGPGGTFLLSYLLRKKVALRSHQDAGAELTARERAEVTGGGKVIQSRLSTSWAGKLRLKVLVPGLRPRGDPSLWFLSTCLRPAPGTHNLEIPCFLVQGLRKWLPRSVSGCSEADGLGGSRKRQGLQGVRKAGVPGPTQWSNKLWVAFGPPRLPHWVCWCWRCWVRAARDPRHHCPSCEAARLGMSWVDSSFLLSSYMRQGLLDPKQMTEFQSQVHPLRAASVGGAASSTWRRVKVSLPLSREKNLGIPLSLQRCKCKASGVNLQRARGRVSVAVCRSVSEQEQERMAPAVPQGVGSWWLLSVPRGEEASCILGCLRFLCADRILSFLSTASLARVPGSKDTLPAHDWVLMVAWVVSSPGDEGWVSMVPWAVSSPRDEGRASTMPWAVCSYGNEGWVSKMPWAVSFPGDEGWMSKMPWAVYSPRNEGWVSKIPWAVSSPGDEGWVSMVPWAVSSPGDDGWVSMVPWAVFALGMRVGCYGILGRCFLSAQGLGDHDVLAMASLGCLFSAMWEEQGRFELVSAHHSLRISRRVSELSGQCSSFGIVFPTLTSIPSKPDMSCGSSEVGVGCSLGLGVSRGRGKERCWSKGMKFLLMGGVSSFDLLHSMVTIVNNNDYFKIAKRGDFKCSHHKMISVGGDGYATYLVLIIPQYRQALSLCIVPQESSHLLFCQLKIETQKERGESNRLFTEPWASASGYNKLQKGFPGNRSLFQPLVTGSRIWEICLDDIHMNGHIQENTVNVIKNSQRKVARNDIHMNGHIQEKTRERNENSQRKVARNDIHMNGHIIGETMVNVIKNSQRKVARNDIHMNGHIQENTVNVIKNSQRKVARNDIHMNGHIQEKTRNVIKNSQRKVARNDIHMNGHITGENTVNVIRIVREKYQKNLQRALVTPNLISFLKNDRYVGDGEVNVFFFKVKIWTLIMHTPLCALQINIIIEYLYIFAHLSQHRLRLSEWTPFGCWVSVSFWGEAAVIENELLAAISGIIKDCELYPQAMAISVPPNAPSNYTLTPVMCVKGSDDAENSTGCEKAGTVLKSKADVLFLFPSVTDSLPSGNKYPQLGLNFCTLLSVHSLTLTHTAGMWAMLGILCMSGMHIHTSTSISCPCICNLLFPCKNTS

SEQ ID NO: 767119 - protein, 2033 aa, Homo sapiens
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTEPHAWVVQGPGGETKRAPAACFCIPAPDPDAVARASRLASELQALKQKLATVQSRLKASAVESLRPSQQAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767120 - protein, 1166 aa, Homo sapiens
MELLISTAHPVLYPSSSLQKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767121 - protein, 1122 aa, Homo sapiens
MGPSRANQRGSEARNFARRVDNAAGQAGNEAEEIWPGESPMLQGRPEMRLGGLARESPMLQGRPEHEAGRFAQGAHHGLREGWKETQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767122 - protein, 1008 aa, Homo sapiens
MELLISTAHPVLYPSSSLQKDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767123 - protein, 703 aa, Homo sapiens
MVCAQEKLEQAEKKATDAEADVASLSRRFSWLRRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767124 - protein, 275 aa, Homo sapiens
GDGVTVETLDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 767125 - protein, 1172 aa, Homo sapiens
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTEPHAWVVQGPGGETKRAPAACFCIPAPDPDAVARASRLASELQALKQKLATVQSRLKASAVESLRPSQQAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTIVATMVLS

SEQ ID NO: 767126 - protein, 932 aa, Homo sapiens
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTEPHAWVVQGPGGETKRAPAACFCIPAPDPDAVARASRLASELQALKQKLATVQSRLKASAVESLRPSQQAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRGRVRALGVSLKAQRKTLKLR

SEQ ID NO: 767127 - protein, 87 aa, Homo sapiens
GLRNSARAQAAAMAGQEDPVQREIHQDWANREYIEIITSSIKKIADFLNSFDMSCRSRLATLNEKLTALERRIEYIEARVTKGETLT

SEQ ID NO: 767128 - protein, 87 aa, Homo sapiens; identical to SEQ ID NO: 767127

SEQ ID NO: 767129 - protein, 147 aa, Homo sapiens [sequence omitted]

SEQ ID NO: 767130 - protein, 42 aa, Homo sapiens
QRLQWAKITPLHSSLGNRARLFRKESKQSWSPVCDYSVSESR

SEQ ID NO: 767131 - protein, 472 aa, Homo sapiens
MLYSIFHFGLMMEKKCTLYFLVLLPFFMILVTAELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLLGIEFVLIPWRPEGKIAEEVYDYIMHILMHFQGLLVSTIFCFFNGEVQAILRRNWNQYKIQFGNSFSNSEALRSASYTVSTISDGPGYSHDCPSEHLNGKSIHDIENVLLKPENLYN

SEQ ID NO: 767132 - protein, 361 aa, Homo sapiens
MLYSIFHFGLMMEKKCTLYFLVLLPFFMILVTAELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLMERYDN

SEQ ID NO: 767133 - protein, 472 aa, Homo sapiens; identical to SEQ ID NO: 767131

SEQ ID NO: 767134 - protein, 288 aa, Homo sapiens
RCVTCAMEPKVAELKQKIEDTLCPFGFEVYPFQVAWYNELLPPAFHLPLPGPTLAFLVLSTPAMFDRALKPFLQSCHLRMLTDPVDQCVAYHLGRVRESLPELQIEIIADYEVHPNRRPKILAQTAAHVAGAAYYYQRQDVEADPWGNQRISGVCIHPRFGGWFAIRGVVLLPGIEVPDLPPRKPHDCVPTRADRIALLEGFNFHWRDWTYRDAVTPQERYSEEQKAYFSTPPAQRLALLGLAQPSEKPSSPSPDLPFTTPAPKKPGNPSRARSWLSPRVSPPASPGP

SEQ ID NO: 767135 - protein, 893 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVTRDEICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVGFAKRLQQGPVAWGRGVLLVHSQQWGWTHRWCLH

SEQ ID NO: 767136 - protein, 911 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVTRDEICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 767137 - protein, 157 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMGRLPHPLRHVRLHGGVTGLLLMEIETILGA

SEQ ID NO: 767138 - protein, 157 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMGRLPHPLRHVRLHGGVTGLLLMKSNTILGA

SEQ ID NO: 767139 - protein, 163 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 767140 - protein, 163 aa, Homo sapiens; identical to SEQ ID NO: 767139

SEQ ID NO: 767141 - protein, 147 aa, Homo sapiens
SSGINAEWPLRPGGTRSSATAQISTMKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 767142 - protein, 122 aa, Homo sapiens
MKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 767143 - protein, 122 aa, Homo sapiens; identical to SEQ ID NO: 767142

SEQ ID NO: 767144 - protein, 163 aa, Homo sapiens; identical to SEQ ID NO: 767139

SEQ ID NO: 767145 - protein, 122 aa, Homo sapiens; identical to SEQ ID NO: 767142

SEQ ID NO: 767146 - protein, 147 aa, Homo sapiens; identical to SEQ ID NO: 767141

SEQ ID NO: 767147 - protein, 145 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKYFHARGNYDAAKRGPGGVWAAEAIRRCQREYPEILWPASAFRVDGVRPLSPS

SEQ ID NO: 767148 - protein, 169 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKYFHARGNYDAAKRGPGGVWAAEAIRRCQSSDVEDEVEDERYDEEEEAERDRLNIKSPFSLSHVPHGKKKLHGEYKN

SEQ ID NO: 767149 - protein, 186 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKYFHARGNYDAAKRGPGGVWAAEAISLVSQYFQTVTDYGKDLMEKVKSPELQAEAKSYFEKSKEQLTPLIKKAGTELVNFLSYFVELGTQPATQ

SEQ ID NO: 767150 - protein, 109 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKSRPPGAQEILPLQPLE

SEQ ID NO: 767151 - protein, 95 aa, Homo sapiens
MPNKRCGRAGARGSKRRQKEEHRRGDHTQDKEPRDESREGGHQHTHRKKARRREDKRKVYSHNHKTRRDVRRKKQSERKRKSGQTDKAYTQKQPR

SEQ ID NO: 767152 - protein, 163 aa, Homo sapiens; identical to SEQ ID NO: 767139

SEQ ID NO: 767153 - protein, 122 aa, Homo sapiens; identical to SEQ ID NO: 767142

SEQ ID NO: 767154 - protein, 122 aa, Homo sapiens; identical to SEQ ID NO: 767142

SEQ ID NO: 767155 - protein, 129 aa, Homo sapiens
SFTGAPGVFSWAPLWGPLGVWFQRSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 767156 - protein, 148 aa, Homo sapiens
FPRDHIQLFFPPKRPARLSINSSHRSLAGGTRSSATAQISTMKLLTGLVFCSLVLGVSSRSFFSFLGEAFDGARDMWRAYSDMREANYIGSDKYFHARGNYDAAKRGPGGVWAAEAISDARENIQRFFGHGAEDSLADQAANEWSLVP

SEQ ID NO: 767157 - protein, 96 aa, Homo sapiens
MKLLTGLVFCSLVLGVSSRSFFSFLGEAFDGARDMWRAYSDMREANYIGSDKYFHARGNYDAAKRGPGGVWAAEAIRQLPGFQTLTSTTLTLSRQF

SEQ ID NO: 767158 - protein, 112 aa, Homo sapiens [sequence omitted]

SEQ ID NO: 767159 - protein, 112 aa, Homo sapiens [sequence omitted]

SEQ ID NO: 767160 - protein, 1723 aa, Homo sapiens
MREKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767161 - protein, 1759 aa, Homo sapiens
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767162 - protein, 1759 aa, Homo sapiens; identical to SEQ ID NO: 767161

SEQ ID NO: 767163 - protein, 1700 aa, Homo sapiens
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767164 - protein, 656 aa, Homo sapiens
LGAIGTGLNPQNFAARQGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767165 - protein, 814 aa, Homo sapiens
LHLQGIIILMIVLYSCCKELIHSFLKDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767166 - protein, 1639 aa, Homo sapiens
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767167 - protein, 249 aa, Homo sapiens
MWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 767168 - protein, 1759 aa, Homo sapiens; identical to SEQ ID NO: 767161

SEQ ID NO: 767169 - protein, 985 aa, Homo sapiens
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASVWSKSTPPAPDNGT

SEQ ID NO: 767170 - protein, 1234 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 767171 - protein, 1234 aa, Homo sapiens; identical to SEQ ID NO: 767170

SEQ ID NO: 767172 - protein, 1234 aa, Homo sapiens; identical to SEQ ID NO: 767170

SEQ ID NO: 767173 - protein, 791 aa, Homo sapiens
MTPLNPYWVNTICPRPLGLSPSHTALRVPLEFPTESPRHTLGKTPPDFLSSCVVLTPHPVALSSAGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 767174 - protein, 1088 aa, Homo sapiens
TRNLRAAAVSSLAGCQGNTDLAKTHLGRDPGRGTCHTFEICVLNEPDKQTEGDSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 767175 - protein, 945 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPRGHRARAGAGWRAGGNDTNAFFFFF

SEQ ID NO: 767176 - protein, 600 aa, Homo sapiens
MSCGYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 767177 - protein, 475 aa, Homo sapiens
MAVVSCGLVATVAQGSPAAQLQSGPQVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 767178 - protein, 602 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVGR

SEQ ID NO: 767179 - protein, 589 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDESGPVKALPKPEV

SEQ ID NO: 767180 - protein, 99 aa, Homo sapiens
RQLWTWVVAGQPLCPPLTASPCILAPQVWSEELFKLAMNILAQNASRNTFLRKAEPQATRGGAGGFTWPFSGCDLFICLPRYTKLKLQVNQDGRIPVKK

SEQ ID NO: 767181 - protein, 154 aa, Homo sapiens
ISQPLRYVTIMNTQLCVGLVVAAWVGGFVHSIVQLALILPLPFCGPNILDNFYCDVPQVLRLACTDTSLLEFLMISNSGLLVIIWFLLLLISYTVILVMLRSHSGKARRKAASTCTTHIIVVSMIFIPCIYIYTWPFTPFLMDKAVSISYTVMT

SEQ ID NO: 767182 - protein, 235 aa, Homo sapiens
MKYVFYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLPLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 767183 - protein, 255 aa, Homo sapiens
MCLRFKEDHNTVSSGELLAHFENVLYLGVLAGTFFFADSSVQKEDPAPYLVYLKSHFNPCVGVLIKPSWVLAPAHCYLPNLKVMLGNFKSRVRDGTEQTINPIQIVRYWNYSHSAPQDDLMLIKLAKPAMLNPKVQPLPLATTNVRPGTVCLLSGLDWSQENSGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 767184 - protein, 109 aa, Homo sapiens
HRGPAIPDWQRHNSHEQGRHPDLRQNLEAPVMSDRECQKTEQGKSHRNSLCVKFVKVFSRIFGEVAVATVICKDKLQGIEVGHFMGGDVGIYTNVYKYVSWIENTAKDK

SEQ ID NO: 767185 - protein, 126 aa, Homo sapiens [sequence omitted]

SEQ ID NO: 767186 - protein, 126 aa, Homo sapiens [sequence omitted]

SEQ ID NO: 767187 - protein, 292 aa, Homo sapiens
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQVQAQLQLEGVAHAHPHLHPHLAAHAPYLMFPPPPFGLPIASLAESASAAAVVAAAAKSNSKNSSIADLRLKARKHAEALGL

SEQ ID NO: 767188 - protein, 225 aa, Homo sapiens
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQMEFCSCRPGWSIMA

SEQ ID NO: 767189 - protein, 319 aa, Homo sapiens
GSTVKSSLITHQQTHTEEKSYMCSECGKGFTMKRYLIAHQRTHSGEKPYVCKECGKGFTVKSNLIVHQRTHTGEKPYICSECGKGFTMKRYLVVHQRTHTGEKPYMCSECGKGFTVKSNLIVHQRSHTGEKSYICSECGKGFTVKRTLVIHQRTHTGEKSYICNECGKGFTTKRTLIIHQRTHTGEKPYECNECGKAFSQKICLIQHERCHTGKTPFVCTECGKSYSHKYGLITHQRIHTGEKPYECNECGKAFTTKSVLNVHQRTHTGERPYGCSDCEKAFSHLSNLVKHKKMHTREMGRISQVENSCNGESQLLPYK

SEQ ID NO: 767190 - protein, 319 aa, Homo sapiens; identical to SEQ ID NO: 767189

SEQ ID NO: 767191 - protein, 319 aa, Homo sapiens; identical to SEQ ID NO: 767189

SEQ ID NO: 767192 - protein, 159 aa, Homo sapiens
SRLVWSGNFRIDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767193 - protein, 794 aa, Homo sapiens
AASCPRRAPRAARQPRCDMARAARRRPRPRSAARPAAERWRREARPGLGASARAAWPPPLRCSPRSVRLAAAAARPSQSMETAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSLAQPATTTARLSSVSSHDSGFVSQDATYSKPPSPMPSDITSQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTGTGLPSGRTPRVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767194 - protein, 345 aa, Homo sapiens
AASCPRRAPRAARQPRCDMARAARRRPRPRSAARPAAERWRREARPGLGASARAAWPPPLRCSPRSVRLAAAAARPSQSMETAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPLRPI

SEQ ID NO: 767195 - protein, 826 aa, Homo sapiens
AASCPRRAPRAARQPRCDMARAARRRPRPRSAARPAAERWRREARPGLGASARAAWPPPLRCSPRSVRLAAAAARPSQSMETAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSAPSSSSSAKGGGAPWPGGAQTYSPSSTCRYRSLAQPATTTARLSSVSSHDSGFVSQDATYSKPPSPMPSDITSQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTGTGLPSGRTPRVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767196 - protein, 199 aa, Homo sapiens
KLMARYDGCGVIRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPLRPI

SEQ ID NO: 767197 - protein, 402 aa, Homo sapiens
AASCPRRAPRAARQPRCDMARAARRRPRPRSAARPAAERWRREARPGLGASARAAWPPPLRCSPRSVRLAAAAARPSQSMETAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSLAQPATTTARLSSVSSHDSGFVSQDATYSKPPSPMPSDITSQVRGR

SEQ ID NO: 767198 - protein, 537 aa, Homo sapiens
FIVGQHCFTHTSNRPKKINSNFITFLQPVVNGELTMLGEITHLQGIIDDLVVLTAEPHKLPPASEQVIKDLKGSDYSWSYQTPPSSPSSSSSRKSSMCSLAQPATTTARLSSVSSHDSGFVSQDATYSKPPSPMPSDITSQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTGTGLPSGRTPRVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767199 - protein, 416 aa, Homo sapiens
SSLLPAGPSVCNRLLASAWQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTGTGLPSGRTPRVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767200 - protein, 334 aa, Homo sapiens
EERYGRVSRSHKPWCGEHQRAAENILLELFLHVPARQLLLNCRLVCSLWRDLIELVTLWKRKLLREGFITEDTIPSQGSDYDCYSVNGDADSEGPPEFDKSSTIPRNSNIAQNYRRLIQTKRPASTAGLPTAGLPTGTGLPSGRTPRVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 767201 - protein, 72 aa, Homo sapiens
RLAGGTVRSRRMRPGPRGYGAIAAAGAGAHPRANHHKELKAAGARVAAGVGAVKEDGQGDSSMVRVVGAGHR

SEQ ID NO: 767202 - protein, 83 aa, Homo sapiens
RLAGGTVRSRRMRPGPRGYGAIAAAGAGAHPRANHHKELKAAGARVAAGVGAGFSGFARPAAPCQEEEETPRACDTMARLAAV

SEQ ID NO: 767203 - protein, 72 aa, Homo sapiens; identical to SEQ ID NO: 767201

SEQ ID NO: 767204 - protein, 72 aa, Homo sapiens; identical to SEQ ID NO: 767201

SEQ ID NO: 767205 - protein, 72 aa, Homo sapiens; identical to SEQ ID NO: 767201

SEQ ID NO: 767206 - protein, 120 aa, Homo sapiens
MGGEFYVKIIFLKEFLIRSIFSSAVGFKNLNSKRDGIRISISSLPSAHALNFTCRFDNVLLLGMLPLLPLQHFFSYFCQDRAYVLYGEKNRFFFQNFIAISPLSFCFQYSIQNAQSHFEA

SEQ ID NO: 767207 - protein, 680 aa, Homo sapiens
MKMKKFQIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGETLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRGHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 767208 - protein, 412 aa, Homo sapiens
ECDKAFNRSLKLTAHKKILMEEKPYKCKECGKAFNLSSTLIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRGHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 767209 - protein, 642 aa, Homo sapiens
MLENYSNLVSVGYHVSKPDVIFKLEQGEEPWIVEEFSNQNYPDIDDALEKNKEIQDKHLTQTVFFSNKTLITERENVFGETLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRGHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 767210 - protein, 642 aa, Homo sapiens; identical to SEQ ID NO: 767209

SEQ ID NO: 767211 - protein, 76 aa, Homo sapiens
ALMGILSNSLFKTPRTWTTFSHHPLPLTDWEQCGVVAKPHGVIKRAGNLGSMFGFALHISYVTFSKISGSLAFFSF

SEQ ID NO: 767212 - protein, 105 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 767213 - protein, 48 aa, Homo sapiens
VRSEEVLLSQPPLHWEKKERGKWGDDDTSNHFLPVSSWAKKKYFKSTV

SEQ ID NO: 767214 - protein, 135 aa, Homo sapiens
MHTREKPTSQEANALSHLHFSQVFWDVKGTCPTSRSFVTAIKEAMRGTRPHSRQCERRLHLDRVAASRSNRAQNQEPAGTEPQSSRFPVSAPLYCLHTRHHLAHPAAPHDRHGACGALLCLKPEPFPGAHIQVAN

SEQ ID NO: 767215 - protein, 256 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINKICLKSFKNSNDFYKF

SEQ ID NO: 767216 - protein, 235 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNDFGQSLPNEKQTSGILSDHQQSQFCKSTGESAQTSQH

SEQ ID NO: 767217 - protein, 159 aa, Homo sapiens
MLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGFENVFSWWQ

SEQ ID NO: 767218 - protein, 327 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 767219 - protein, 327 aa, Homo sapiens; identical to SEQ ID NO: 767218

SEQ ID NO: 767220 - protein, 327 aa, Homo sapiens; identical to SEQ ID NO: 767218

SEQ ID NO: 767221 - protein, 207 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGRLVNLPYRFFFSSIIRKIPIIIKRLWENKAVLV

SEQ ID NO: 767222 - protein, 262 aa, Homo sapiens
MCSFQILKPSEKKAKYQYGGLNSGRPVTPPRTANPPKKREERNSVKKPSDLLRTYFIIYKCASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 767223 - protein, 184 aa, Homo sapiens
MADGELNVDSLITRLLEAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 767224 - protein, 110 aa, Homo sapiens
MADGELNVDSLITRLLEVRGCRPGKIVQMTEAEVRGLCIKSREIFLSQPILLELEAPLKICEDFMDIYHFPSQNLIISYELSLNLVNPGIFFKLRMYVASDPVMIVYLPP

SEQ ID NO: 767225 - protein, 327 aa, Homo sapiens; identical to SEQ ID NO: 767218

SEQ ID NO: 767226 - protein, 363 aa, Homo sapiens
NSAGKIEAAAGAGSRDTGEPQAALGVLRPQRASRGGASLAKGTGSEECAHPQAVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 767227 - protein, 127 aa, Homo sapiens
MADGELNVDSLITRLLEVRGCRPGKIVQMTEAEVRGLCIKSREIFLSQPILLELEAPLKICGEIHGQYTDLHENPFLTSLGKLTLSLFPPSIRRMYLNECWSVGHFVNYGYWVLNCLILPCECCIRL

SEQ ID NO: 767228 - protein, 187 aa, Homo sapiens
LFVGVVVVDGGSACAYLAAGAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 767229 - protein, 88 aa, Homo sapiens
GPAAVPCVLPRGPRWQHGLRTGASVSEKGPSRTCCSAHTSPMRCTLGRAAARVLLLNVVGPSVPSVAGQLTLLHVKDQPGQHGETRLY

SEQ ID NO: 767230 - protein, 199 aa, Homo sapiens
AEASFCFPGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGYWRVRLITSGKVLARVADVLMPPSFLEGTCPRSTASLLLTPQPQSTSCLVQSSSQEG

SEQ ID NO: 767231 - protein, 369 aa, Homo sapiens
RKPAVPEARSAGTSEAGRSGAEEVSCGSVSGDGAAMRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNVIQPNYPAAARDFLQTFRRGLLGSVMLDLDVLRGHPPAETLP

SEQ ID NO: 767232 - protein, 378 aa, Homo sapiens
RKPAVPEARSAGTSEAGRSGAEEVSCGSVSGDGAAMRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCVLTSAAASTGTVLDHLVGEETMADYLLYTLNKHQRFGYVQHYGLGSACDNVERVLKSVAVKLGKTQKVKVLTGTGNVNVIQPNYPAAARDFLQTFRRGLLGSVMLDLDVLRGHPPAETLP

SEQ ID NO: 767233 - protein, 150 aa, Homo sapiens [sequence omitted]

SEQ ID NO: 767234 - protein, 150 aa, Homo sapiens [sequence omitted]

SEQ ID NO: 767235 - protein, 175 aa, Homo sapiens
SGHCVRKTRSGGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNVIQPNYPAAARDFLQTFRRGLLGSVMLDLDVLRGHPPAETLP

SEQ ID NO: 767236 - protein, 286 aa, Homo sapiens
RKPAVPEARSAGTSEAGRSGAEEVSCGSVSGDGAAMRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFG

SEQ ID NO: 767237 - protein, 320 aa, Homo sapiens
PEARSAGGPQRRNLRGGSQRRRGGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNVIQPNYPAAARDFLQTFRRGLLGSVMLDLDVLRGHPPAETLP

SEQ ID NO: 767238 - protein, 369 aa, Homo sapiens; identical to SEQ ID NO: 767231

SEQ ID NO: 767239 - protein, 256 aa, Homo sapiens
RKPAVPEARSAGTSEAGRSGAEEVSCGSVSGDGAAMRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQRWSPQGPGPALCQELCRRLAPADLCVASGC

SEQ ID NO: 767240 - protein, 148 aa, Homo sapiens [sequence omitted]

SEQ ID NO: 767241 - protein, 215 aa, Homo sapiens
RKPAVPEARSAGTSEAGRSGAEEVSCGSVSGDGAAMRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKVDTRLPSGRP

SEQ ID NO: 767242 - protein, 256 aa, Homo sapiens; identical to SEQ ID NO: 767239

SEQ ID NO: 767243 - protein, 38 aa, Homo sapiens
RVLLIQITSESTEEFPEDGVAMLPVRKTGLDSDLDGEN

SEQ ID NO: 767244 - protein, 109 aa, Homo sapiens [sequence omitted]

SEQ ID NO: 767245 - protein, 125 aa, Homo sapiens
RPESPAPVGCFKDPTWEETIFSLLALLREGCVGQSCPLPLTAVGLPLPISVPRPEPYSLLQGLSCPGNCSGAIGERTERWPGAVAHACNPSTLGGQGRWIVRSGVRDQPGQHSETPSLLKIQKLA

SEQ ID NO: 767246 - protein, 167 aa, Homo sapiens
MERFVVTAPPARNRSKTALYVTPLDRVTEFGGELHEDGGKLFCTSCNVVLNHVRKSAISDHLKSKTHTKRKAEFEEQNVRKKQRPLTASLQCNSTAQTEKVSVIQDFVKMCLEANIPLEKADHPAVRAFLSRHVKNGGSIPKSDQLRRAYLPDGYENENQLLNSQDC

SEQ ID NO: 767247 - protein, 125 aa, Homo sapiens
CWGPPTGSAIGGAGGRGAAGDTAAAAGLDRATAATAAATDPPPPLFPCSSFFLFFSFPAGPRPLSLTAASILRYQGAREAEGGPDRWCGLWGPGPSVQKLEPGAGLGHSCLQEEEGGDGKLDSRP

SEQ ID NO: 767248 - protein, 167 aa, Homo sapiens; identical to SEQ ID NO: 767246

SEQ ID NO: 767249 - protein, 167 aa, Homo sapiens; identical to SEQ ID NO: 767246

SEQ ID NO: 767250 - protein, 167 aa, Homo sapiens; identical to SEQ ID NO: 767246

SEQ ID NO: 767251 - protein, 72 aa, Homo sapiens
LGTAYGLCHRRCRRTGRGGGHGGRRGARSGNGGDGGSDGSSSSLIPLLLFLPFLFLSGRASSTFPNGGLDPT

SEQ ID NO: 767252 - protein, 167 aa, Homo sapiens; identical to SEQ ID NO: 767246

SEQ ID NO: 767253 - protein, 167 aa, Homo sapiens; identical to SEQ ID NO: 767246

SEQ ID NO: 767254 - protein, 145 aa, Homo sapiens
ELGTRLSFGGELHEDGGKLFCTSCNVVLNHVRKSAISDHLKSKTHTKRKAEFEEQNVRKKQRPLTASLQCNSTAQTEKVSVIQDFVKMCLEANIPLEKADHPAVRAFLSRHVKNGGSIPKSDQLRRAYLPDGYENENQLLNSQDC

SEQ ID NO: 767255 - protein, 167 aa, Homo sapiens; identical to SEQ ID NO: 767246

SEQ ID NO: 767256 - protein, 167 aa, Homo sapiens; identical to SEQ ID NO: 767246

SEQ ID NO: 767257 - protein, 167 aa, Homo sapiens; identical to SEQ ID NO: 767246

SEQ ID NO: 767258 - protein, 167 aa, Homo sapiens; identical to SEQ ID NO: 767246

SEQ ID NO: 767259 - protein, 175 aa, Homo sapiens
AAASARRLPPPPLRLPPSRLSSSRAHSWHLGLGLAQLAGSGRLGAGVLGLAPEERAQTPGTSRAPPLPRPRPNPRAWGAGGGAKRADHRGGPGRGSVRVNVGIGFVVTYKVILETPAWWQLLTFLFIFSVTLLPSPIFSFHLFFVFYSKGMTSWHHRENRVQAQKLFPHHHLLKN

SEQ ID NO: 767260 - protein, 167 aa, Homo sapiens; identical to SEQ ID NO: 767246

SEQ ID NO: 767261 - protein, 167 aa, Homo sapiens; identical to SEQ ID NO: 767246

SEQ ID NO: 767262 - protein, 175 aa, Homo sapiens; identical to SEQ ID NO: 767259

SEQ ID NO: 767263 - protein, 173 aa, Homo sapiens
AAASARRLPPPPLRLPPSRLSSSRAHSWHLGLGLAQLAGSGRLGAGVLGLAPEERAQTPGTSRAPPLPRPRPNPRAWGAGGGAKRADHRGGPGRGSVRVNVGIGFVVTYKVILETPAWWQLLTFLFIFSVTLLPSPIFSFHLFFVFYSKGMTSWHHRENRVQAQKLFPHHHLI

SEQ ID NO: 767264 - protein, 167 aa, Homo sapiens; identical to SEQ ID NO: 767246

SEQ ID NO: 767265 - protein, 167 aa, Homo sapiens; identical to SEQ ID NO: 767246

SEQ ID NO: 767266 - protein, 167 aa, Homo sapiens; identical to SEQ ID NO: 767246

SEQ ID NO: 767267 - protein, 167 aa, Homo sapiens; identical to SEQ ID NO: 767246

SEQ ID NO: 767268 - protein, 167 aa, Homo sapiens; identical to SEQ ID NO: 767246

SEQ ID NO: 767269 - protein, 167 aa, Homo sapiens; identical to SEQ ID NO: 767246

SEQ ID NO: 767270 - protein, 110 aa, Homo sapiens
MWTVPSFTNDSYQVYNVFSTNSFQLLTVKRTPHEAWRVPLTTKTNKTKGLPDCPKKPTNGPFIVTSILWDNCNAPKAVVLQTLAMGIVIDWAPKGHYWQDCSSKNTLCSE

SEQ ID NO: 767271 - protein, 384 aa, Homo sapiens
ARRATPAASQEALRSCFQPLSECQPSQGTSSQSQRRVASASVARAVPVGSRVRGGGAAGRPAAAMGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPITKNHKDYPFHIEY

SEQ ID NO: 767272 - protein, 371 aa, Homo sapiens
ARRATPAASQEALRSCFQPLSECQPSQGTSSQSQRRVASASVARAVPVGSRVRGGGAAGRPAAAMGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 767273 - protein, 203 aa, Homo sapiens
MGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 767274 - protein, 254 aa, Homo sapiens
MQVIFSTAPWPNLPRAQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPM

SEQ ID NO: 767275 - protein, 371 aa, Homo sapiens; identical to SEQ ID NO: 767272

SEQ ID NO: 767276 - protein, 197 aa, Homo sapiens [sequence omitted]

SEQ ID NO: 767277 - protein, 237 aa, Homo sapiens
MQVIFSTAPWPNLPRAQASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVCYTLRGNAIL

SEQ ID NO: 767278 - protein, 112 aa, Homo sapiens
GRKIRLKCFLGRCRSVKEFEKLNRIGEGTYGIVYRARDTQTDEIVALKKVRMDKEKDGIPISSLREITLLLRLRHPNILTDFLPSPCTLEGKVWRLHPWLQGSQCPSSPCLE

SEQ ID NO: 767279 - protein, 280 aa, Homo sapiens [sequence omitted]

SEQ ID NO: 767280 - protein, 230 aa, Homo sapiens
MDFCWDWQRCFQTTNGYLSDSRSRPGNYNVAALATSSLVGVVQSIKDHITKPTAMAQGRVAHLIEWKGWSAQRAGWELSPAEDEHYCCLPDELREARFAAGVAEQFAITEATLSAWSSLDEEELHPENSPQGIVQLQDLESIYLQDSLPSGPSQDDSLQAFSSPSPSPDSCPSPEEPPSTAGIPQPPSPELQHRRRLPGAQGPEGGTHPPGSLPSMDSGSLWEEDEVFYN

SEQ ID NO: 767281 - protein, 88 aa, Homo sapiens
GGARSRPAESGSWVPGPLTSLGCTGRCEPEALSRPSGTGHKRATEMGRELCPQGGGFPSHPRGWLGKGGGFSCGETFRAGLARSLTLG

SEQ ID NO: 767282 - protein, 90 aa, Homo sapiens
SSWYPFPLSKDPNIVIAKMDATANDVPSPYEVRGFPTIYFSPANKKLNPKKYEGGRELSDFISYLQREATNPPVIQEEKPKKKKKAQEDL

SEQ ID NO: 767283 - protein, 505 aa, Homo sapiens
MRLRRLALFPGVALLLAAARLAAASDVLELTDDNFESSISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 767284 - protein, 505 aa, Homo sapiens; identical to SEQ ID NO: 767283

SEQ ID NO: 767285 - protein, 259 aa, Homo sapiens [sequence omitted]

SEQ ID NO: 767286 - protein, 468 aa, Homo sapiens
MRLRRLALFPGVALLLAAARLAAASDVLELTDDNFESSISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNSAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 767287 - protein, 414 aa, Homo sapiens
MRLRRLALFPGVALLLAAARLAAASDVLELTDDNFESSISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCDPSANNEH

SEQ ID NO: 767288 - protein, 383 aa, Homo sapiens
AEVRLGQTRERSSGLVVARPTSAVPAEPRPFRPSPPHLAAMRLRRLALFPGVALLIAAARLAAASDVLELTDDNFESSISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFS

SEQ ID NO: 767289 - protein, 168 aa, Homo sapiens [sequence omitted]

SEQ ID NO: 767290 - protein, 97 aa, Homo sapiens
LALLQVIQSDPVQSEYPNIVLAQMDADEMNDSSLLRHEVRSFPTIYFSPANKKLNPKKYEGGRELSDFISYLQREATNPPVIQEEKPKKKKKAQEDL

SEQ ID NO: 767291 - protein, 183 aa, Homo sapiens
LAHRVAAHCVVMSAFCQGLSDILLVGTVRKLEDEISELLALERHGLSPHLSARSIDQSPVLINNIYNRDQFSGMRSKGDIGHPANLQKRLNTMLAALGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 767292 - protein, 186 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQDQCVEITEESKALLEEYNKTTMLLSKQFVQWDELLCQLEAATQVKPAEE

SEQ ID NO: 767293 - protein, 186 aa, Homo sapiens; identical to SEQ ID NO: 767292

SEQ ID NO: 767294 - protein, 146 aa, Homo sapiens
HEVLKPCFTELERVKILYKKIEDLIKYLDPEYIDRIAIPDASKLQFILAEEQFILSQVALLEQVNALVPMLDSAHIKAVPEHAARLQRLAQIHIQQQDQCVEITEESKALLEEYNKTTMLLSKQFVQWDELLCQLEAATQVKPAEE

SEQ ID NO: 767295 - protein, 186 aa, Homo sapiens; identical to SEQ ID NO: 767292

SEQ ID NO: 767296 - protein, 186 aa, Homo sapiens; identical to SEQ ID NO: 767292

SEQ ID NO: 767297 - protein, 158 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAAVPEHAARLQRLAQIHIQQQDQCVEITEESKALLEEYNKTTMLLSKQFVQWDELLCQLEAATQVKPAEE

SEQ ID NO: 767298 - protein, 154 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQFLSVLHFGPTGPVCGNH

SEQ ID NO: 767299 - protein, 176 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQIPILTLTYNQTMLLSKQFVQWDELLCQLEAATQVKPAEE

SEQ ID NO: 767300 - protein, 186 aa, Homo sapiens; identical to SEQ ID NO: 767292

SEQ ID NO: 767301 - protein, 176 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQAPWGVGVRDEAGSLVEDVGFAQFLSVLHFGPTGPVCGNH

SEQ ID NO: 767302 - protein, 186 aa, Homo sapiens; identical to SEQ ID NO: 767292

SEQ ID NO: 767303 - protein, 129 aa, Homo sapiens
LQECNLGKDKLLLCKDELQLRGIRYGNAVDVLRIQVLDQIFNLFVENLHPLPLAGQLLTSTVPEHAARLQRLAQIHIQQQDQCVEITEESKALLEEYNKTTMLLSKQFVQWDELLCQLEAATQVKPAEE

SEQ ID NO: 767304 - protein, 163 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQDQCVEITEESKALLEEYNKTVSFLLN

SEQ ID NO: 767305 - protein, 167 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAGNAGLHVYMHLRMWVVGEVKHRDGLSIQSSGGYKPWMLLSGIVAWFWVEDPMDPLVDIEYSIPLHQLQAMVPATVGAS

SEQ ID NO: 767306 - protein, 75 aa, Homo sapiens
LNPSGYPFKYSEQFSQLLVFKCLLERQSFSIHLPSSFGLREGSHTHAFGLLMRLETARAELDDPSHSPSFTALFV

SEQ ID NO: 767307 - protein, 305 aa, Homo sapiens
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQNHDAADKAAVVKFHPIQGHRVEVKKAVPKEDIYSGGGGGGSRSSRGGRGGRGRGGGRDQNGLSKGGGGGYNSYGGYGGGGGGGYNAYGGGGGGSSYGGSDYGNGFGGFGSYSQHQSSYGPMKSGGGGGGGGSSWGGRSNSGPYRGGYGGGGGYGGSSF

SEQ ID NO: 767308 - protein, 86 aa, Homo sapiens
LSSGRGRRGGGYNAYGGGGGGSSYGGSDYGNGFGGFGSYSQHQSSYGPMKSGGGGGGGGSSWGGRSNSGPYRGGYGGGGGYGGSSF

SEQ ID NO: 767309 - protein, 305 aa, Homo sapiens; identical to SEQ ID NO: 767307

SEQ ID NO: 767310 - protein, 305 aa, Homo sapiens; identical to SEQ ID NO: 767307

SEQ ID NO: 767311 - protein, 305 aa, Homo sapiens; identical to SEQ ID NO: 767307

SEQ ID NO: 767312 - protein, 305 aa, Homo sapiens; identical to SEQ ID NO: 767307

SEQ ID NO: 767313 - protein, 305 aa, Homo sapiens; identical to SEQ ID NO: 767307

SEQ ID NO: 767314 - protein, 305 aa, Homo sapiens; identical to SEQ ID NO: 767307

SEQ ID NO: 767315 - protein, 305 aa, Homo sapiens; identical to SEQ ID NO: 767307

SEQ ID NO: 767316 - protein, 305 aa, Homo sapiens; identical to SEQ ID NO: 767307

SEQ ID NO: 767317 - protein, 305 aa, Homo sapiens; identical to SEQ ID NO: 767307

SEQ ID NO: 767318 - protein, 305 aa, Homo sapiens; identical to SEQ ID NO: 767307

SEQ ID NO: 767319 - protein, 305 aa, Homo sapiens; identical to SEQ ID NO: 767307

SEQ ID NO: 767320 - protein, 193 aa, Homo sapiens
QFEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGGKSVSYK

SEQ ID NO: 767321 - protein, 140 aa, Homo sapiens
MDRSNPVKPALDYFSNRLVNYQISVKCSNQFKLEVCLLNAENKVVDNQAGTQGQLKVLGANLWWPYLMHEHPASLYSWEDGDCSHQSLGPLPACDLCDQLHLRSRQGGSVCGCDPCEQLLLLVSQLRAPGVDSAAAGRPV

SEQ ID NO: 767322 - protein, 140 aa, Homo sapiens; identical to SEQ ID NO: 767321

SEQ ID NO: 767323 - protein, 140 aa, Homo sapiens; identical to SEQ ID NO: 767321

SEQ ID NO: 767324 - protein, 140 aa, Homo sapiens; identical to SEQ ID NO: 767321

SEQ ID NO: 767325 - protein, 140 aa, Homo sapiens; identical to SEQ ID NO: 767321

SEQ ID NO: 767326 - protein, 155 aa, Homo sapiens
MVIAHTKALDPSQPVTFVTNSTYAADKGALYVDVIRVNSYYSWYRNYGHLELIQLQLAAQFENWCKTSQSHYSERVWSGNACRVSPVFPRNSDEVFQQNERVNQEEDDIRSRRYNRGDNLQDACEERSLDPRMIIGQVVHNPAGQKTSRETHSRR

SEQ ID NO: 767327 - protein, 140 aa, Homo sapiens; identical to SEQ ID NO: 767321

SEQ ID NO: 767328 - protein, 186 aa, Homo sapiens
MVIAHTKALDPSQPVTFVTNSTYAADKGALYVDVIRVNSYYSWYRNYGHLELIQLQLAAQFENWCKTSQSHYSERVWSGNACRVSPGLVNYQISVKCSNQFKLEVCLLNAENKVVDNQAGTQGQLKVLGANLWWPYLMHEHPASLYSWEDGDCSHQSLGPLPACDLCDNSTYAADKGALYVDVIRV

SEQ ID NO: 767329 - protein, 140 aa, Homo sapiens; identical to SEQ ID NO: 767321

SEQ ID NO: 767330 - protein, 75 aa, Homo sapiens
SPCVSVLLFGGGGGGKMAAHGGSAASSALKGLIQQFTTITDRVLLCHPGWSTMVRSQLTATSASRVQAVLLASAS

SEQ ID NO: 767331 - protein, 505 aa, Homo sapiens
SPCVSVLLFGGGGGGKMAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 767332 - protein, 505 aa, Homo sapiens; identical to SEQ ID NO: 767331

SEQ ID NO: 767333 - protein, 435 aa, Homo sapiens
LVYPPAVQFMQVPTVRPYTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVKHVQSKGYPNERFELLTNFPRRKLSHLDYDITLQEAGLCPQETVFVQERN

SEQ ID NO: 767334 - protein, 505 aa, Homo sapiens; identical to SEQ ID NO: 767331

SEQ ID NO: 767335 - protein, 120 aa, Homo sapiens
HLMEHTIPAASTRRGLILTLQFGHQIGKKEKCGGRGIDVNGPKAQLMLRYPDGKREQITLPEQAKLLALVKHVQSKGYPNERFELLTNFPRRKLSHLDYDITLQEAGLCPQETVFVQERN

SEQ ID NO: 767336 - protein, 700 aa, Homo sapiens
MLGRKRTRKIDFESDKRKIQGDGMETTRKAGRGGSCLESQHFGRRRWADHLRSGDRGQPEQHGETPSLLKIQKLPGCGGVHLYIPATQRLRQGNGLNLGGRGCSEPRSHHYTPAWATKRHSISNLKKKKKKKKKTSGKKDERNTFLKLVSEGTGEEKTTVPNEKRTGNLILIGMHQILLCTFASSISRRIVQNVYFLPMLRKQVERTYSGLIASEWQIRIGIQSPCCGLLQQENQATQMILFSLFGFVKCHLVLFPSNIEEVVGLKLWDLHYAYTFLFMPLFGEADYCFFKMMHWRRCESKIATWHYLPRINEKGKKTIFSFFKHFSEKIQLPFLIGERHHARLIFDIFSETPSLLKNTKISQAWWLSVIPANGEAEAQESLEPEEAEVAVSRDHTTALHPGQWSETLSQKIINEDMIPACFIQLERHTTHEIIGEHVNVYLLVQLRKREEYVLVSKVLNKTEVASTVAHVFFGLTFFFSSTFCNFYDLGHEVLPLRHNQYPSRKGLLIPGVKIPSLRGSHYGSPGVKIPSSQESYLQHLGKIPEGATSNRKMKERFNFSTQVTNPMHSIVYVICRKGTGGVRALWVTALLVVTFTLLFLLNLWFLVLKNEIIGQINSSQPFLEQQIRLSLKSFSKISCFQSLPVIAIIPRLIKSVLVNQFLYFFFLSFFYSVFRYHLTNNLLFNLTAMTEISKEESIVV

SEQ ID NO: 767337 - protein, 210 aa, Homo sapiens
SPCVSVLLFGGGGGGKMAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQRSCEEYYPGTFHFLAGLS

SEQ ID NO: 767338 - protein, 505 aa, Homo sapiens; identical to SEQ ID NO: 767331

SEQ ID NO: 767339 - protein, 505 aa, Homo sapiens; identical to SEQ ID NO: 767331

SEQ ID NO: 767340 - protein, 470 aa, Homo sapiens
SPCVSVLLFGGGGGGKMAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHFDSTQTKQDSRSDEESESELFSGSEEFISVCGSDEEEEVENLAKSRKSPHKDLGHRKEENRRPLTEPPVRTDPGTATNHQGLPAVDSEILEMPPEKADGVVEGIDVNGPKAQLMLRYPDGKREQITLPEQAKLLALVSTCSLKTRCYRQHEL

SEQ ID NO: 767341 - protein, 321 aa, Homo sapiens
SPCVSVLLFGGGGGGKMAAHGGSAASSALKGLIQQFTTITGASESVGKHMLEACNNNLEMAVTMFLDGGGIAEEPSTSSASVSTVRPHTEEEVRAPIPQKQEILVEPEPLFGAPKRRRPARSIFDGFRDFQTETIRQEQELRNGGAIDKKLTTLADLFRPPIDLMHKGSFETAKECGQMQNKWLMINIQNVQDFACQCLNRDVWSNEAVKNIIREHFIFWQVYHDSEEGQRYIQFYKLGDFPYVSILDPRTGQKLVEWHQLDVSSFLDQVTGFLGEHGQLDGLSSSPPKKCARSESLIDASEDSQLEAAIRASLQETHQIN

SEQ ID NO: 767342 - protein, 422 aa, Homo sapiens
MGRNVMRHMSDDLGSYVSLSCDDFSSQELEIFICSFSSSWLQMFVAEAVFKKLCLQSSGSVSSEPLSLQKMVYSYLPALGKTGVLGSGKIQVSKKIGQRPCFDSQRTLLMLNGTKQKQVEGLPELLDLNLAKCSSSLKKLKKKSEGELSCSKENCPSVVKKMNFHKTNLKGETALHRACINNQVEKLILLLSLPGIDINVKDNAGWTPLHEACNYGNTVCVQEILQRCPEVDLLTQVDGVTPLHDALSNGHVEIGKLLLQHGGPVLLQQRNAKGELPLDYVVSPQIKEELFAITKIEDTVENFHAQAEKHFHYQQLEFGSFLLSRMLLNFCSIFDLSSEFILASKGLTHLNELLMACKSHKETTSVHTDWLLDLYAGNIKTLQKLPHILKELPENLKVCPGVHTEALMITLEMMCRSVMEFS

SEQ ID NO: 767343 - protein, 422 aa, Homo sapiens; identical to SEQ ID NO: 767342

SEQ ID NO: 767344 - protein, 422 aa, Homo sapiens; identical to SEQ ID NO: 767342

SEQ ID NO: 767345 - protein, 116 aa, Homo sapiens
LSFFLNLLLSLTKPKELQPNSKSHPTQDQNWMSQKCVLFLQELIDMPVSDLPRMRPQLPVAHEPRLAFSILGVSLHHLSIHPSLHSFNHETIHSSLNGSFFKRFVIELSPSTSTLS

SEQ ID NO: 767346 - protein, 73 aa, Homo sapiens
SQKRLRNDLMEEIQKTQTDLTGMRNYNIDSGNYPGWGNRLDFTEETMRHLEDTSVETICICWASRETEPIGDS

SEQ ID NO: 767347 - protein, 115 aa, Homo sapiens
VPYVPGPFSDTPEFTYQPQQPGQDFPVSPWLTLCPVGCPECPPHLWDTEEHLKLSSASLKVYSKLALGPLQLQRSVAGSFLEAVIMHCRTAQPRCTSCLSRGPNLAPTTGRARGH

SEQ ID NO: 767348 - protein, 91 aa, Homo sapiens
TEKAPGNRTSAHKPCIRAASGLSEGGDLGKSSDFRRCEGGKGSRCDGSFQSAGMGPLPRLLELRAPLRPAPPHPQQYASLACFRIHLEFGL

SEQ ID NO: 767349 - protein, 132 aa, Homo sapiens
LFSAINKTEAVRCEYEDTHKAFAKAFWRMDRLLGLGRKEVSRVQWSGCSAVTCILEGKPKSPYAHKNWKRKNTHDGLAESSPSQEMPKIISGILHVANTDVILGVICHICKMSILSHNPSQLCQHFPSKLQT

SEQ ID NO: 767350 - protein, 756 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEETFDLKTPQVTNEGEPEKGLCLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 767351 - protein, 770 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSEGSDDCSEMCDGEERQEAQKQGRKVIKRVAQWILWILQTTPLWENPRGKEEKRGGMAGAEMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 767352 - protein, 152 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNGNYSSQQLWGIQAHFIH

SEQ ID NO: 767353 - protein, 847 aa, Homo sapiens
MVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 767354 - protein, 172 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNENLSSSAVLCQLVSPNKDWRSHEESLAHTGTLRRSCM

SEQ ID NO: 767355 - protein, 152 aa, Homo sapiens
MVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNENLSSSAVLCQLVSPNKDWRSHEESLAHTGTLRRSCM

SEQ ID NO: 767356 - protein, 867 aa, Homo sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 767357 - protein, 723 aa, Homo sapiens
MNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 767358 - protein, 104 aa, Homo sapiens
MLKAFSKWHPKICRWFATDFKMRSLGHSTCREGLFSEPPSSAQRQILKRKFNHHESQPQVSHQPGKSKWDHREGCWQRHHPIQALTSSPEGCSRQHLLPRRPFV

SEQ ID NO: 767359 - protein, 581 aa, Homo sapiens
MNNVNDLEDRPRLLPYGKQENSNACHEMDDIAVPQEALSSSARCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQKNSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAER

SEQ ID NO: 767360 - protein, 137 aa, Homo sapiens
RVRMRYPQGHYDCALGDEVILKGTTTVPLGMRYPLKMVSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767361 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767362 - protein, 258 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVPDLPMAVLKWRGKPVP

SEQ ID NO: 767363 - protein, 493 aa, Homo sapiens; identical to SEQ ID NO: 767361

SEQ ID NO: 767364 - protein, 475 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767365 - protein, 272 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVVPGTSPTACSWKWRRKSTVQSACTQWTVSP

SEQ ID NO: 767366 - protein, 417 aa, Homo sapiens
MVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767367 - protein, 622 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGAYLLPSRAQSSCRPAVWGALAGTPRLHLNHRDLRTRRGSRESPDTAFYNSRFQLHSSGSKVAIKHVTCILNTVEKQRKLKQVQTFTIFVNWQFSGHLLTGLGEPQWVTEQVEESPHPHLLVALTACFVGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767368 - protein, 475 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTVCAILQHFNLKPLVDPKDIDLSPIHIGFGCIPPRYKLCVIPRS

SEQ ID NO: 767369 - protein, 367 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVAQS

SEQ ID NO: 767370 - protein, 356 aa, Homo sapiens [sequence omitted]

SEQ ID NO: 767371 - protein, 304 aa, Homo sapiens
MGWGNRAMRAGSRGRPTSCWKHSGRPKLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767372 - protein, 347 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEGPPTCPMKQPETPFSEDTSSPRAQS

SEQ ID NO: 767373 - protein, 443 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENECVLEKAWLAWSCFFCCVPFCSILI

SEQ ID NO: 767374 - protein, 338 aa, Homo sapiens
MGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767375 - protein, 192 aa, Homo sapiens
MGGCPTGQEPIPEICPIHILAEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 767376 - protein, 166 aa, Homo sapiens [sequence omitted]

SEQ ID NO: 767377 - protein, 75 aa, Homo sapiens
MSHAVVQKPNSRWPTGTLKFLYCYCLCFYHNKYPDPSLLRIQNCPPSFIGLVRFYPLSYLQFSRISVECAGNGIS

SEQ ID NO: 767378 - protein, 75 aa, Homo sapiens; identical to SEQ ID NO: 767377

SEQ ID NO: 767379 - protein, 52 aa, Homo sapiens
MWERWVPVTVLPGCVGCRTVAALASWTVRDVKERIFAETGFPVSEQRLWRGG

SEQ ID NO: 767380 - protein, 55 aa, Homo sapiens
METKENRWVPVTVLPGCVGCRTVAALASWTVRDVKERIFAETGFPVSEQRLWRGG

SEQ ID NO: 767381 - protein, 93 aa, Homo sapiens
AVLGGGKEGGSRGVGQGSSRAEVGLGSQRERSGTCGAEAAAAAAQLIAGTGSSLPYLHSLRHRNWYIQATCATSGDGLYEGLDWLANQLKNKK

SEQ ID NO: 767382 - protein, 108 aa, Homo sapiens
LPRVKVRVPLCRTGGWEPAQQELPTPETDARAPLKGPARSCFTDMSHPGQHFHSAFVPTHECSAACHYVYPRGWLMSPHAGKSRSDKLNGKLNAWQGTHKPATRSHQR

SEQ ID NO: 767383 - protein, 794 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 767384 - protein, 794 aa, Homo sapiens; identical to SEQ ID NO: 767383

SEQ ID NO: 767385 - protein, 913 aa, Homo sapiens
MEFLTDVTNTFHQLILKDFQINGQNNEILALRDLFHLVLVCFLRNVINEIFEESSYLVMYVTSLTFIFICLFLRQGLILSPRWSAVVQSQLTAAPTSWAQAILLLSLPSSWDHRQLYLSMNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 767386 - protein, 557 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVMRQTMLLPHQHRTFWIK

SEQ ID NO: 767387 - protein, 514 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSWVKKTPNPKRGPPKG

SEQ ID NO: 767388 - protein, 794 aa, Homo sapiens; identical to SEQ ID NO: 767383

SEQ ID NO: 767389 - protein, 794 aa, Homo sapiens; identical to SEQ ID NO: 767383

SEQ ID NO: 767390 - protein, 712 aa, Homo sapiens
IPESGLWPAQRMGQNGAACCLPLQTSLFAISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 767391 - protein, 144 aa, Homo sapiens
MKGEKPFQCSQCDMRFIQKYLLQRHEKIHTGEKPFRCDECGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 767392 - protein, 106 aa, Homo sapiens
IAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 767393 - protein, 138 aa, Homo sapiens
LLWSSVTWTSALCLMASIYKPNPVTKAVSLSSTSPVTFSFWHLPLANADSFTHSSSCKVLVCQCLFIKSPLFLVSFQAHYVCSLQTTTVLIRFHPSIHLYVYSSRIFSVFSNNMLGSGFADMNQFNPCSSGKIKQAER

SEQ ID NO: 767394 - protein, 168 aa, Homo sapiens
MKTSLDLTNYPLMMLTAGLLISNCLCHFFIFPWCQPCLHIRAAFYDPMALTSTDHNTKPTMIRRPPAVVCYICGREYGTKSISIHEPQCLKKWHNENNLLPKELRRPVPKKPEVRTITAKGFYDLDALNEAAWTSAHSQLVPCNVCGRTFLPDRLIVHQRSCKPKAAK

SEQ ID NO: 767395 - protein, 120 aa, Homo sapiens
MKTSLDLTNYPLMMLTAGLLISNCLCHFFIFPWCQPCLHIRAAFYDPMALTSTDHNTKPTMIRRPPAVVCYICGREYGTKSISIHEPQCLKKWHNENNLLPKELRRPVPKKPEVRTITDK

SEQ ID NO: 767396 - protein, 194 aa, Homo sapiens
MERGKKKRISNKLQQTFHHSKEPTFLINQAGLLSSDSYSSLSPETESVNPGENIKTDTQKKRPGTVILSKLSSRRIISESQLSPPVIPARRPGFRVCYICGREFGSQSIAIHEPQCLQKWHIENSKLPKHLRRPEPSKPQSLSSSGSYSLQATNEAAFQSAQAQLLPCESCGRTFLPDHLLVHHRSCKPKGEGP

SEQ ID NO: 767397 - protein, 187 aa, Homo sapiens
RPLGPLVLALGGAAAVLGSVLFILWKTYFGRGRERRWDRGEAWWGAEAARLPEWDEWDPEDEEDEEPALEELEQREVLVLGLDGAGKSTFLRVLSGKPPLEGHIPTWGFNSVRLPTKDFEVDLLEIGGSQNLRFYWKEFVSEVDVLVFVVDSADRLRLPWARQELHKLLDKDPDLPVVVVANKQMLK

SEQ ID NO: 767398 - protein, 110 aa, Homo sapiens
GSWKCQGVSTWEQPLNNTVGFGGQIPQRPCPSAGKLQGACSMLAFESPSGIQLQLPTVVGNCLIPTFCLLLSLPKFTSPLSCWSFLGLPPKSMPCTCILVSGFASGKTQL

SEQ ID NO: 767399 - protein, 80 aa, Homo sapiens
MGPDGSGSEPASLVAPNSPSFLFTCHGRRWGTEGLLVKSEEGRFNRGSIWALRINKRLKIPASWELATERVDWFQYSCLK

SEQ ID NO: 767400 - protein, 398 aa, Homo sapiens
MHHEWLGAGAGHPVGLAHPQWLPTGGGGGGDWAGAHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 767401 - protein, 463 aa, Homo sapiens
ERRRRRRRRARGGMATTAQYLPRGPGGGAGGTGPLMHPDAAAAAAAAAAAERLHAGAAYREVQKLMHHEWLGAGAGHPVGLAHPQWLPTGGGGGGDWAGAHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 767402 - protein, 433 aa, Homo sapiens
MHHEWLGAGAGHPVGLAHPQWLPTGGGGGGDWAGAHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPATKVTSTNPVLIVLKAIRRLWWHNTTRGDADNRLAHSERQDLLHHHAASLTYYTAYQHTHVDRRLAEVTHEGRAPAARMQARRAARP

SEQ ID NO: 767403 - protein, 211 aa, Homo sapiens
RSVLCPGPEAQPGHQVEHQLRVAQRSVPSTEPPAAAEMLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 767404 - protein, 186 aa, Homo sapiens
RSVLCPGPEAQPGHQVEHQLRVAQRSVPSTEPPAAAEMLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVEEFQSPFASQSRGYFLFRPRNGRRSAGFI

SEQ ID NO: 767405 - protein, 184 aa, Homo sapiens
RSVLCPGPEAQPGHQVEHQLRVAQRSVPSTEPPAAAEMLRTESCRPRSPAGQVAAASPLLLLLLLLAWCAGACRGAPILPQGLQPEQQLQLWNEIDDTCSSFLSIDSQPQASNALEELCFMIMGMLPKPQSSVVHPLLQLVPHLHERRMKRFRVDEEFQSPFASQSRGYFLFRPRNGRRSAGFI

SEQ ID NO: 767406 - protein, 375 aa, Homo sapiens
HEPRNKDFTDKVPWNQREAGMETPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 767407 - protein, 565 aa, Homo sapiens
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGRERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 767408 - protein, 273 aa, Homo sapiens
MNVINAARVEEYAEKICQGLCGFGVLSCFFVLMSTLCQKVIPLFSSTYWHEELRVDSSQGGLLIGRLAVGVERGKGCQLQSVWCMGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 767409 - protein, 557 aa, Homo sapiens
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGRERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGIWAKKESLFKLNFLGLGEV

SEQ ID NO: 767410 - protein, 565 aa, Homo sapiens; identical to SEQ ID NO: 767407

SEQ ID NO: 767411 - protein, 197 aa, Homo sapiens [sequence omitted]

SEQ ID NO: 767412 - protein, 173 aa, Homo sapiens
MVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 767413 - protein, 173 aa, Homo sapiens; identical to SEQ ID NO: 767412

SEQ ID NO: 767414 - protein, 155 aa, Homo sapiens
GRVGRPTRPDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 767415 - protein, 503 aa, Homo sapiens
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGRERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALR

SEQ ID NO: 767416 - protein, 133 aa, Homo sapiens
GHKVSRVLGHQVRKCSQKARGRNAVCLQCFCKVERLFFQEKATSSSSQPCAVTPTPQAGEWNHRCFPSWSQSQSGWAKCPEKSHLLGSHQPGHSRTPRQGPIPEAQLNACSHCRKVWKVVLQPTRHGEPKTQP

SEQ ID NO: 767417 - protein, 98 aa, Homo sapiens
MTLLGICPRGMKASIPCKLILTQQRDSRRPKAETPQTSISGQTGRCNALSVPWDVTQPYEGKTPVRMSPGTTVLRDPVTHGQNRHGPEPEAGRMRAGG

SEQ ID NO: 767418 - protein, 98 aa, Homo sapiens; identical to SEQ ID NO: 767417

SEQ ID NO: 767419 - protein, 1240 aa, Homo sapiens
MDLAPYFTSEPLSAVQKLGGPVVLHCSAQPVTTRISWLHNGKTLDGNLEHIKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVEYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMITFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 767420 - protein, 216 aa, Homo sapiens
RARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 767421 - protein, 201 aa, Homo sapiens
WGCLEVPSTVVSESPSMILPCSISPWQKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 767422 - protein, 107 aa, Homo sapiens
MEELGVREMEGEVPTTLVCPQIADLTQKIFDLRGKFKRPTLRRVRISADAMMQALLGARAKESLDLRAHLKQVKKEDTEKENREVGDWRKNIDALSGMEGRKKKFES

SEQ ID NO: 767423 - protein, 432 aa, Homo sapiens
RARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGMSSGSPSSPEETDGPWDPEGHPGGPLTDPPNAPVLALPPAIPGLSLSMADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 767424 - protein, 369 aa, Homo sapiens
MVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGMSSGSPSSPEETDGPWDPEGHPGGPLTDPPNAPVLALPPAIPGLSLSMADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 767425 - protein, 153 aa, Homo sapiens [sequence omitted]

SEQ ID NO: 767426 - protein, 216 aa, Homo sapiens
RARATGGDLEEQQHAEGSPEPGTPAAPTPESFTVHFLPLNSAQTLHHKSCYNGRFQLLYVACGTQTPVLPPLLPHCLGSQSPILPPDLELNLSLSSVLSAVMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTCG

SEQ ID NO: 767427 - protein, 145 aa, Homo sapiens
RARATGGDLEEQQHAEGSPEPGTPAAPTPESFTVHFLPLNSAQTLHHKSCYNGRFQLLYVACGTQTPVLPPLLPHCLGSQSPILPPDLELNLSLSSVLSAVMVHLLIPELGACVAPGGNLIVELARYLVDVRQEQLQGFNTRECW

SEQ ID NO: 767428 - protein, 206 aa, Homo sapiens
VLLGVGRGLGTVETKLEGLEGQRRFPTPGLYPEAPGGLRFPPTPLQTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 767429 - protein, 470 aa, Homo sapiens
RARATGGDLEEQQHAEGSPEPGTPAAPTPESFTVHFLPLNSAQTLHHKSCYNGRFQLLYVACGTQTPVLPPLLPHCLGSQSPILPPDLELNLSLSSVLSAVMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGMSSGSPSSPEETDGPWDPEGHPGGPLTDPPNAPVLALPPAIPGLSLSMADGSSDAAREPRPAPAPIRRRSSNYRAYATEPHAKKKSKISASRKLQLKTLLLQIAKQELEREAEERRGEKGRALSTRCQPLELAGLGFAELQDLCRQLHARVDKVDEERYDIEAKVTKNITEIADLTQKIFDLRGKFKRPTLRRVRISADAMMQALLGARAKESLDLRAHLKQVKKEDTEKENREVGDWRKNIDALSGMEGRKKKFES

SEQ ID NO: 767430 - protein, 196 aa, Homo sapiens
PSFPRTQTPVLPPLLPHCLGSQSPILPPDLELNLSLSSVLSAVMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 767431 - protein, 122 aa, Homo sapiens
RARATGGDLEEQQHAEGSPEPGTPAAPTPESFTVHFLPLNSAQTLHHKSCYNGRFQLLYVACGTQTPVLPPLLPHCLGSQSPILPPDLELNLSLSSVLSAVVLNFILIIPTQYPPPPPRECW

SEQ ID NO: 767432 - protein, 325 aa, Homo sapiens
DQCAVLAIKYLTIMKVKNDKHLKNIYKEAYRIGTLFHLTKHKTDEMEDKIAEVRRKFKGREEFLKKLTQGEVAAGMVLQKKLYSIYEVQALERKELIKNRAICAMSLAELQEPLLQLEDEAERIRSLNKEHSVMLNNIIDQKDLIRRKVGKVKKKLRKKGKKTLDALIETESKRSAIFKDLEATKSKTMIFYAKINELNEELKAKEEEKKSFDQTLEILKNKFITMRFKREHAQTVFDHYMQEKKDCEERIFEEDQRFRVLLAVRQKTLQDTQKIIADSLEENLRLAQEYQQLQITFLKEKDNYFNIYDKQLSLDTSIRDKKQVL

SEQ ID NO: 767433 - protein, 213 aa, Homo sapiens
LSLSHYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWSVASELEKIQKFNLLLENSGILNQISNKKNEQQSFDHYKPGSSETLLGEVNENRVSIALKKTSEILHDIDCLLSNSKK

SEQ ID NO: 767434 - protein, 213 aa, Homo sapiens; identical to SEQ ID NO: 767433

SEQ ID NO: 767435 - protein, 53 aa, Homo sapiens
MSQLRVPWSSYNWPCRKHPQPCDEGIPARRRIWWPDSPASLRQASPPRALPGT

SEQ ID NO: 767436 - protein, 183 aa, Homo sapiens [sequence omitted]

SEQ ID NO: 767437 - protein, 277 aa, Homo sapiens
MGDLFCLTLGSPDVLKPETLLAEVWLTSCRAIASKYTVVEPRPNLHLPRLLSSSFGLSESKAAHISSPRGSCSVQPRPRGKLCICPVQPYTAVQAGAPHTHTPLDITLAAGSRQLTSLLDPEKQEVGGLTWALCLAVSPDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 767438 - protein, 614 aa, Homo sapiens
KARAPARRGGLGRRGGCGARPVAAGPGPKPCRSARPGPAEAAAPPPPRGRTRSKLPELRGQSPEAAKLSGLATLPRDPHPGRRSGRPPLTAPPQTRAWTPRASGATGRATMLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSGNPARGRGSRRD

SEQ ID NO: 767439 - protein, 740 aa, Homo sapiens
KARAPARRGGLGRRGGCGARPVAAGPGPKPCRSARPGPAEAAAPPPPRGRTRSKLPELRGQSPEAAKLSGLATLPRDPHPGRRSGRPPLTAPPQTRAWTPRASGATGRATMLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 767440 - protein, 614 aa, Homo sapiens; identical to SEQ ID NO: 767438

SEQ ID NO: 767441 - protein, 210 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767442 - protein, 210 aa, Homo sapiens; identical to SEQ ID NO: 767441

SEQ ID NO: 767443 - protein, 210 aa, Homo sapiens; identical to SEQ ID NO: 767441

SEQ ID NO: 767444 - protein, 187 aa, Homo sapiens
ASSWVIGEGMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767445 - protein, 195 aa, Homo sapiens
RTRGSTHASLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767446 - protein, 178 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767447 - protein, 196 aa, Homo sapiens
RLSRGWVNRSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767448 - protein, 195 aa, Homo sapiens; identical to SEQ ID NO: 767445

SEQ ID NO: 767449 - protein, 210 aa, Homo sapiens; identical to SEQ ID NO: 767441

SEQ ID NO: 767450 - protein, 210 aa, Homo sapiens; identical to SEQ ID NO: 767441

SEQ ID NO: 767451 - protein, 192 aa, Homo sapiens
TSGSVDGHYGWMGSMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767452 - protein, 178 aa, Homo sapiens; identical to SEQ ID NO: 767446

SEQ ID NO: 767453 - protein, 210 aa, Homo sapiens; identical to SEQ ID NO: 767441

SEQ ID NO: 767454 - protein, 190 aa, Homo sapiens
HQLGRGPAVIGRMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767455 - protein, 210 aa, Homo sapiens; identical to SEQ ID NO: 767441

SEQ ID NO: 767456 - protein, 355 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPTWECVLCCPHSPHEPTYPGSPQARETLFLSCFRTNEGAGEAPLTREGAAAGCSPCPCYSLTSKFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 767457 - protein, 248 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 767458 - protein, 156 aa, Homo sapiens
MSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767459 - protein, 156 aa, Homo sapiens; identical to SEQ ID NO: 767458

SEQ ID NO: 767460 - protein, 219 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQAVSGPDVPSTPAAEAKAAEAAASAYYNPGNPHNVYMPTSQPPPPPYYPPEDKKTQ

SEQ ID NO: 767461 - protein, 120 aa, Homo sapiens
MATLTCPAGPMSIPRQSPMECTAVPSWATPYPPAPPEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 767462 - protein, 120 aa, Homo sapiens; identical to SEQ ID NO: 767461

SEQ ID NO: 767463 - protein, 210 aa, Homo sapiens; identical to SEQ ID NO: 767441

SEQ ID NO: 767464 - protein, 131 aa, Homo sapiens
MPARSPQCCPAYLPHRLGLFWEHGASPVPVSLSASPLEGTLWPPPPPQSSSLSLAPTATLSLMSHFRPARCLPGPCQTLLTFPLLVCAGLRRPPRPHSTQPGSSCSPRHPSFPSLSWVMLLPPCVTFEAVK

SEQ ID NO: 767465 - protein, 202 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLG

SEQ ID NO: 767466 - protein, 131 aa, Homo sapiens; identical to SEQ ID NO: 767464

SEQ ID NO: 767467 - protein, 194 aa, Homo sapiens
GRVGRPTRPSSLYPTPPIGAVLGLGEGRGRLVLPPGLIINNYQELALWDIRAPGLGRGAAQLPMPARSPQCCPAYLPHRLGLFWEHGASPVPVSLSASPLEGTLWPPPPPQSSSLSLAPTATLSLMSHFRPARCLPGPCQTLLTFPLLVCAGLRRPPRPHSTQPGSSCSPRHPSFPSLSWVMLLPPCVTFEAVK

SEQ ID NO: 767468 - protein, 173 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQGIQAPKIRG

SEQ ID NO: 767469 - protein, 135 aa, Homo sapiens
LADSNKKTPLGAGRRGAQAHCVLSLGTPVGETMALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGR

SEQ ID NO: 767470 - protein, 112 aa, Homo sapiens
MQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYRRALLGYPLSTGPT

SEQ ID NO: 767471 - protein, 261 aa, Homo sapiens
NSRPRTRLREDDGECRAAVMAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767472 - protein, 279 aa, Homo sapiens
DRNGRAVMTTSSRQRRRWRPGDWEGFRGCRSECRAAVMAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767473 - protein, 279 aa, Homo sapiens; identical to SEQ ID NO: 767472

SEQ ID NO: 767474 - protein, 210 aa, Homo sapiens
LGTDYAPRRGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767475 - protein, 207 aa, Homo sapiens
IRGRYHGCEKTTGSAELLSWRPLCGASFPSCCCCCYRGMSRARRTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767476 - protein, 241 aa, Homo sapiens
MVPRAFGKGGPPGAWLGLGNPGKGKVGGPGIREDPPFKELGPVPVWSQGVEALKNWDLGRPRVALVRREKEPRRVSLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767477 - protein, 239 aa, Homo sapiens
DRNGRAVMTTSSRQRRRWRPGDWEGFRGCRSECRAAVMAAALWGFFPVLLLLLLSGDVQSSEVPGAAAEGSGGSGVGIGDRFKIEGRAVVPGVKPQDWISAARVLVDGEEHVGFLKARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 767478 - protein, 157 aa, Homo sapiens
DRNGRAVMTTSSRQRRRWRPGDWEGFRGCRSECRAAVMAAALWGFFPVLLLLLLSGDVQSSEVPGAAAEGSGGSGVGIGDRFKIEGRAVVPGVKPQDWISAARVLVDGEEHVGFLNMVPGVISLNWLCARRLPSEISGFLQGICNAYDTYGFSPQYL

SEQ ID NO: 767479 - protein, 279 aa, Homo sapiens; identical to SEQ ID NO: 767472

SEQ ID NO: 767480 - protein, 279 aa, Homo sapiens; identical to SEQ ID NO: 767472

SEQ ID NO: 767481 - protein, 151 aa, Homo sapiens
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGAASSLAVPSASLSQTLPKCP

SEQ ID NO: 767482 - protein, 151 aa, Homo sapiens; identical to SEQ ID NO: 767481

SEQ ID NO: 767483 - protein, 151 aa, Homo sapiens; identical to SEQ ID NO: 767481

SEQ ID NO: 767484 - protein, 151 aa, Homo sapiens; identical to SEQ ID NO: 767481

SEQ ID NO: 767485 - protein, 105 aa, Homo sapiens [sequence omitted]

SEQ ID NO: 767486 - protein, 151 aa, Homo sapiens; identical to SEQ ID NO: 767481

SEQ ID NO: 767487 - protein, 108 aa, Homo sapiens
MQNYKYDKAIVPESKNGGRARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 767488 - protein, 125 aa, Homo sapiens
MVKGHSFSIQVSKKRPILLLAGLPFLIIETSTIKPYHRGFYCNDESIKYPLKTGETINDAVLCAVGIVIAILAIITGEFYRIYYLKKSRSTIQNPYVAALYKQVGAASSLAVPSASLSQTLPKCP

SEQ ID NO: 767489 - protein, 118 aa, Homo sapiens
MQNYKYDKAIVPESKNGGSPALNNNPRRSGSKRVLLICLDLFCLFMAGLPFLIIETSTMANVSTRLRPLLESGHCWCSLPKSQNLICSNPVTSLPFTLSVDSFILVISFSIVKVLCLS

SEQ ID NO: 767490 - protein, 151 aa, Homo sapiens; identical to SEQ ID NO: 767481

SEQ ID NO: 767491 - protein, 151 aa, Homo sapiens; identical to SEQ ID NO: 767481

SEQ ID NO: 767492 - protein, 133 aa, Homo sapiens
MQNYKYDKAIVPESKNGGSPALNNNPRRSGSKRVLLICLDLFCLFMAGLPFLIIETSTIKPYHRGFYCNDESIKYPLAILAIITGEFYRIYYLKKSRSTIQNPYVAALYKQVGAASSLAVPSASLSQTLPKCP

SEQ ID NO: 767493 - protein, 151 aa, Homo sapiens; identical to SEQ ID NO: 767481

SEQ ID NO: 767494 - protein, 139 aa, Homo sapiens
RPEEQPQVQSDLSKEVLLEFHKTLVLKEDKEGEENCTDRLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 767495 - protein, 165 aa, Homo sapiens
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGAASSLAVPSASLSQTLPKIHIAAHDARNSTESRK

SEQ ID NO: 767496 - protein, 511 aa, Homo sapiens
MRVACGTWASLILVMCYVWICLGGLTLAVDRSSFKTCDRGRSFCKRQRIVRQGSLHTETLLDSLHALDLITLDGSTLIHEVTKVLLVLELQGLQKNMTRFRIDELEPRGPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSSLMFSGNMLVSQEPGVAPTLLPRYHQSRWNYRDELMCWKWNRDMMITNLPCDCHTGKTMDKLTAKRDYHLGPQSLPQPGACLRRLVTRGRKLVASQNPHQGLRYRVHEELGPGAVLNLDGLNIGGSQHGSPVYPKRRGKSK

SEQ ID NO: 767497 - protein, 96 aa, Homo sapiens
FGMRKHPGMATPEETQGKAEKDEPGAWEETFKTHSDSKPYGPMSVGLDFSLPGMEHVYGIPYLGALNSPRVYPFMPLVCWCHFLEEDEGNELGLLF

SEQ ID NO: 767498 - protein, 532 aa, Homo sapiens
MRVACGTWASLILVMCYVWICLGGLTLAVDRSSFKTCDRGRSFCKRQRIVRQGSLHTETLLDSLHALDLITLDGSTLIHEVTKVLLVLELQGLQKNMTRFRIDELEPRGPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFLQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSSLMFSGNMLVSQEPGVAPTLLPRYHQSRWNYRDELMCWKWNRALMITNLPCDVTLARQMDKLMAKRDYHLGPQSLPQPGACLRRLVTRGRKLVASQNPHQGLRYRVHEELGPGAVLNLDGLNIGGSQHGSPVYPKRRGKSK

SEQ ID NO: 767499 - protein, 203 aa, Homo sapiens
MAGPELLLDSNIRLWVVLPIVIITFFVGMIRHYVSILLQSDKKLTQEQVSDRKYLSGLVQWLTPIIPALWGAEMGGSLEPRNLRPTLAACQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASW

SEQ ID NO: 767500 - protein, 261 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 767501 - protein, 212 aa, Homo sapiens
MFSTKPPHLASEQKSCPCCGWKRSVLEEGKSGVPRVLGGRAEPHEPSLSQCLLGTPISAGAPAGAGEQRVPVAVGRQPVQGPRHLLLLLCEEMCTKGLGAQTGVLRMKGVNLSCVRTCMVVAEERPRIALTQSFSKLFKDLGLPARAVSTTFGCRVNVAICLQVRCLGPAVLESWLLAAWRPSFPVVNVPFCSRLIYFSFSGPLISHFHVTF

SEQ ID NO: 767502 - protein, 251 aa, Homo sapiens
MICPFRHYYLCSKFCTEIVPFIFRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 767503 - protein, 411 aa, Homo sapiens
MFSTKPPHLASEQKSCPCCGWKRSVLEEGKSGVPRVLGGRAEPHEPSLSQCLLGTPISAGAPAGAGEQRVPVAVGRQPVQGPRHLLLLLCEEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 767504 - protein, 251 aa, Homo sapiens; identical to SEQ ID NO: 767502

SEQ ID NO: 767505 - protein, 232 aa, Homo sapiens
FNVTESRESRVMFSLTRDIALLLPDPPRREGHHRTHRDQRTLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 767506 - protein, 200 aa, Homo sapiens
PTRRGRVGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767507 - protein, 186 aa, Homo sapiens [sequence omitted]

SEQ ID NO: 767508 - protein, 209 aa, Homo sapiens
VLISGFRMLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767509 - protein, 183 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767510 - protein, 165 aa, Homo sapiens
VLISGFRMLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVVLMAHHALTGGLLTDLRL

SEQ ID NO: 767511 - protein, 186 aa, Homo sapiens [sequence omitted]

SEQ ID NO: 767512 - protein, 186 aa, Homo sapiens [sequence omitted]

SEQ ID NO: 767513 - protein, 186 aa, Homo sapiens [sequence omitted]

SEQ ID NO: 767514 - protein, 183 aa, Homo sapiens; identical to SEQ ID NO: 767509

SEQ ID NO: 767515 - protein, 197 aa, Homo sapiens
DLELVSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767516 - protein, 200 aa, Homo sapiens; identical to SEQ ID NO: 767506

SEQ ID NO: 767517 - protein, 121 aa, Homo sapiens
MAIGVSECSSVEVGPGVARPCVPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767518 - protein, 105 aa, Homo sapiens
DLELVSGKAFGMPTMRLLSFVVLALFAVTQAEEGARLLASKSLLNRYAVEGRDLTLQYNIYNVGSSAALDVELSDDSFPPEDFGIVSGMLNVKWDRIAPYPLGTW

SEQ ID NO: 767519 - protein, 200 aa, Homo sapiens; identical to SEQ ID NO: 767506

SEQ ID NO: 767520 - protein, 200 aa, Homo sapiens; identical to SEQ ID NO: 767506

SEQ ID NO: 767521 - protein, 96 aa, Homo sapiens
RRYEDPQKCGLKSRGNMTLPKRRRTDWGFHSPPLPRNPGSSPKKSRCFPDSKGYLKCNLFSLSPWPLSPGSCPALSHSEGPALGVCESLLGSIVKP

SEQ ID NO: 767522 - protein, 186 aa, Homo sapiens [sequence omitted]

SEQ ID NO: 767523 - protein, 209 aa, Homo sapiens; identical to SEQ ID NO: 767508

SEQ ID NO: 767524 - protein, 212 aa, Homo sapiens
PTRRGRVGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKRLSGATKTGREPWGRR

SEQ ID NO: 767525 - protein, 209 aa, Homo sapiens; identical to SEQ ID NO: 767508

SEQ ID NO: 767526 - protein, 209 aa, Homo sapiens; identical to SEQ ID NO: 767508

SEQ ID NO: 767527 - protein, 186 aa, Homo sapiens [sequence omitted]

SEQ ID NO: 767528 - protein, 186 aa, Homo sapiens [sequence omitted]

SEQ ID NO: 767529 - protein, 186 aa, Homo sapiens
VLISGFRMLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFVSFLVFSLISSLV

SEQ ID NO: 767530 - protein, 121 aa, Homo sapiens
MLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPHFLLDPALLSAIVKDQP

SEQ ID NO: 767531 - protein, 183 aa, Homo sapiens; identical to SEQ ID NO: 767509

SEQ ID NO: 767532 - protein, 183 aa, Homo sapiens; identical to SEQ ID NO: 767509

SEQ ID NO: 767533 - protein, 190 aa, Homo sapiens
VLHRMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767534 - protein, 164 aa, Homo sapiens
ANDEAAVISLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767535 - protein, 95 aa, Homo sapiens
ITGDPGIPGSQAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 767536 - protein, 127 aa, Homo sapiens
SRTSLRKGVWDANDEAAVICGVGSICCHSSRGRSQAFGFQITAEQIRRGGTRPDLAVQHLQCWLKIGSTSAPGQGGILAQREFDRRFSPHFLDWAAFGVMTLPSIGIPLLLWYSSKRKYDTPKTKKN

SEQ ID NO: 767537 - protein, 239 aa, Homo sapiens
VLISGFRMLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQCHNGTWIAPASNVSHTVVLRPLKAGYFNFTSATITYLAQEDGPVVIGSFSGLGSLWGHDPSLHRHPPAIVVLQQEEI

SEQ ID NO: 767538 - protein, 243 aa, Homo sapiens
VLHRMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPSSSPKKSRCFPDSKGYLKCNLFSLSPWPLSPGSCPALSHSEGPALGVCESLLGSIVKP

SEQ ID NO: 767539 - protein, 108 aa, Homo sapiens
DVVHFHLNDYRSVKDVVEAASHIEQRGGTETRTAFGIEFARSEAFQNEEELIGASTALLSQEIQAPLPRNPGAFQTPKGILNAISSLLALGHFLLDPALLSAIVKDQP

SEQ ID NO: 767540 - protein, 200 aa, Homo sapiens; identical to SEQ ID NO: 767506

SEQ ID NO: 767541 - protein, 150 aa, Homo sapiens
PTRRGRVGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVNQPQDSLVLPGS

SEQ ID NO: 767542 - protein, 725 aa, Homo sapiens
RPARRRWSLRTVGGELSLAYPRLGWPGCHFCLPALQTMDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 767543 - protein, 620 aa, Homo sapiens
SSRADAYYYYYYYSCEKTTEWGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 767544 - protein, 443 aa, Homo sapiens [sequence omitted]

SEQ ID NO: 767545 - protein, 326 aa, Homo sapiens
MELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 767546 - protein, 725 aa, Homo sapiens; identical to SEQ ID NO: 767542

SEQ ID NO: 767547 - protein, 688 aa, Homo sapiens
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 767548 - protein, 688 aa, Homo sapiens; identical to SEQ ID NO: 767547

SEQ ID NO: 767549 - protein, 466 aa, Homo sapiens
MRSAGPPCRPLCWPDPWQPLRTCVSFLPLHSPLQSLHAGGGFWACPCTLTSRCHLRTLVPLRRDPEGALGEGEMGNPLSPPTPVASPGRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 767550 - protein, 725 aa, Homo sapiens; identical to SEQ ID NO: 767542

SEQ ID NO: 767551 - protein, 151 aa, Homo sapiens
VGTQVLRAEGTGIGGTLWEAFGVGFPRPLAHLHLGFGEGEPLQGMAAGKGPLATPSNPTAGFCVRARRNPGPLFLEACQQPLGPGTVGEATRTLPPVCLGLRRAWCAVGLQHSVMVRPGRLCVALSHPSVPTLPRQTLPSSKRKPGQRLLS

SEQ ID NO: 767552 - protein, 873 aa, Homo sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 767553 - protein, 380 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVMGEDIPEKIKDEVHPEVKCVGSVALTALVTVSSEEFEDKWFRKIKDHFCPFENQFHTEIQILA

SEQ ID NO: 767554 - protein, 133 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATRKPQAGYRA

SEQ ID NO: 767555 - protein, 873 aa, Homo sapiens; identical to SEQ ID NO: 767552

SEQ ID NO: 767556 - protein, 873 aa, Homo sapiens; identical to SEQ ID NO: 767552

SEQ ID NO: 767557 - protein, 264 aa, Homo sapiens
RVADAWVDPRVKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 767558 - protein, 348 aa, Homo sapiens
MLRKLWQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVMGEDIPEKIKDEVHPEVKCVGSVALTALVTVSSEEFEDKWFRKIKDHFCPFENQFHTEIQILA

SEQ ID NO: 767559 - protein, 325 aa, Homo sapiens
MLPQGYPEPTDYKKYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVMGEDIPEKIKDEVHPEVKCVGSVALTALVTVSSEEFEDKWFRKIKDHFCPFENQFHTEIQILA

SEQ ID NO: 767560 - protein, 334 aa, Homo sapiens
LPRCPRRGREMDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVSVSLGFM

SEQ ID NO: 767561 - protein, 873 aa, Homo sapiens; identical to SEQ ID NO: 767552

SEQ ID NO: 767562 - protein, 322 aa, Homo sapiens
LPRCPRRGREMDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTIA

SEQ ID NO: 767563 - protein, 873 aa, Homo sapiens; identical to SEQ ID NO: 767552

SEQ ID NO: 767564 - protein, 113 aa, Homo sapiens
SKSEALGIEMIVLVRVGTCFLTWWDLQPTQYLGFLNISSRLSFIWKRWDFSPRIETFRFFRLLLQFTQPQQTSFALERNLRTQQEIEDKMKGFSFKEDTLLLIAEVSVSLGFM

SEQ ID NO: 767565 - protein, 292 aa, Homo sapiens
MLRKLWQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEVSVSLGFM

SEQ ID NO: 767566 - protein, 873 aa, Homo sapiens; identical to SEQ ID NO: 767552

SEQ ID NO: 767567 - protein, 873 aa, Homo sapiens; identical to SEQ ID NO: 767552

SEQ ID NO: 767568 - protein, 873 aa, Homo sapiens; identical to SEQ ID NO: 767552

SEQ ID NO: 767569 - protein, 380 aa, Homo sapiens; identical to SEQ ID NO: 767553

SEQ ID NO: 767570 - protein, 380 aa, Homo sapiens; identical to SEQ ID NO: 767553

SEQ ID NO: 767571 - protein, 369 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEYGKISKKKKKKFFQKKKKKKGGKILGKKKGFFFPKPPPPQEERVKKVWVVLAP

SEQ ID NO: 767572 - protein, 319 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKTIFCLQKLISLHPFNPWNWGKLAEAYLNLGPALSAALASSQKQHSFTSSDKTIKSFFPHSGKDCLLCFPETLPESSLFSVEANSSNSQKNEKALTNIQNCMAEKRETVLIETQLKACASFIRTRLLLQFTQPQQTSFALERNLRTQQEIEDKMKGFSFKEDTLLLIAEGQI

SEQ ID NO: 767573 - protein, 153 aa, Homo sapiens
MDSGCWLFGGEFEDSVFEERPERRSGPPASYCAKLCEPQWFYEETESSDDVEVLTLKKFKGDLAYRRQEYQKALQEYSSISEKLSSTNFAMKRDVQEGQARCLAHLGRHMEALEIAANLENKATNTDHLTTVLYLQLAICSSLQNLEKREKQC

SEQ ID NO: 767574 - protein, 156 aa, Homo sapiens
MWKRSDHQPKIKAEDGPLVGQFEVLGSVPEPAMPHPLELSEFESFPVFQDIRLHIREVGAQLVKKVNAVFQLDITKNGKTILRWTIDLKNGSGDMYPGPARLPADTVFTIPESVFMELVLGKMNPQKAFLAGKFKVSGKVLLSWKLERVFKDWAKF

SEQ ID NO: 767575 - protein, 156 aa, Homo sapiens; identical to SEQ ID NO: 767574

SEQ ID NO: 767576 - protein, 97 aa, Homo sapiens
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 767577 - protein, 97 aa, Homo sapiens; identical to SEQ ID NO: 767576

SEQ ID NO: 767578 - protein, 117 aa, Homo sapiens
MTIDSGQEDKHGYSALYRSPMNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 767579 - protein, 97 aa, Homo sapiens; identical to SEQ ID NO: 767576

SEQ ID NO: 767580 - protein, 120 aa, Homo sapiens
MKDNTIYSSSPIPTVYSALYRSPMNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 767581 - protein, 97 aa, Homo sapiens; identical to SEQ ID NO: 767576

SEQ ID NO: 767582 - protein, 97 aa, Homo sapiens; identical to SEQ ID NO: 767576

SEQ ID NO: 767583 - protein, 134 aa, Homo sapiens
AGGRAGFWDSAKNSRCSLTSPALPIPFDCLRSPVSLSSTADSKSPQKQTTARCTEVRSRAVERERRIRGILEGHREAVRRVRCTGELRVDRWSVPISFAVRMMRQHRRSCYLEKMTKNWAGLVACDCSPSYSGG

SEQ ID NO: 767584 - protein, 86 aa, Homo sapiens
NVEPVPTQRTCCQDIVNDVSSDGSEDPAEFSRGDSCAHSETENNIVSWNALILPPVPEGCAEKTMWSPPGIPLDSPTEVLQQPRET

SEQ ID NO: 767585 - protein, 799 aa, Homo sapiens
SAPVRARVSSPQLRVFRSGRPRRLRVLRINRTSVALRLAGTGRFVAKTPGHPGSWEMGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPYKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKLYKCKVCSKSYARSSNLIMHQRVHTGEKPYKCKECGKVFSRSSCLTQHRKIHTGENLYKCKVCAKPFTCFSNLIVHERIHTGEKPYKCKECGKAFPYSSHLIRHYRIHTGEKPYKCKACSKSFSDSSGLSVHRRTHTGEKPYTCKECGKAFSYSSDVIQHRRIHTGQRPYKCEECGKAFNYRSYLTTHQRSHTGERPYKCEECGKAFNSRSYLTTHRRRHTGERPYKCDECGKAFSYRSYLTTHRRSHSGERPYKCEECGKAFNSRSYLIAHQRSHTREKL

SEQ ID NO: 767586 - protein, 623 aa, Homo sapiens
SAPVRARVSSPQLRVFRSGRPRRLRVLRINRTSVALRLAGTGRFVAKTPGHPGSWEMGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPYKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKHTNVKHVANLLVTPQVFLCIGELILERNPIHVKNVAKPLVIVQMLFSIGEFILARDPTNVKNVAKPSTIGHTSLHIREVILEKNFKNVKHGADFLLVTHVLLCIR

SEQ ID NO: 767587 - protein, 799 aa, Homo sapiens; identical to SEQ ID NO: 767585

SEQ ID NO: 767588 - protein, 715 aa, Homo sapiens
SAPVRARVSSPQLRVFRSGRPRRLRVLRINRTSVALRLAGTGRFVAKTPGHPGSWEMGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPYKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKLYKCKVCSKSYARSSNLIMHQRVHTGEKPYKCKECGKVFSRSSCLTQHRKIHTGENLYKCKVCAKPFTCFSNLIVHERIHTGEKPYKCKECGKAFPYSSHLIRHYRIHTGEKPYKCKACSKSFSDSSGLSVHRRTHTGEKPYTCKECGKAFSYSSDVIQHRRIHTGQRPYKCEECGKAFNYRSYLIAHQRSHTREKL

SEQ ID NO: 767589 - protein, 69 aa, Homo sapiens
NLSGSQREPQTEGSMDGWRRMPRWGLLLLLWGSCTFGLPTDTTTFKRFIRKFYTEFDRRNNRIGFALAR

SEQ ID NO: 767590 - protein, 368 aa, Homo sapiens
MPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 767591 - protein, 420 aa, Homo sapiens
NLSGSQREPQTEGSMDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 767592 - protein, 420 aa, Homo sapiens; identical to SEQ ID NO: 767591

SEQ ID NO: 767593 - protein, 153 aa, Homo sapiens
TRHGLPKCWDYRREPPCPARKYILYSKCYRLRRQFLGLAVKLFRIFFKWCSQELFSGKLEAIGKASRSLLFFAMEGQLWDLYTWACFSMEWSQDSLLRTLPETFPVCFVFNFFLAILLACKYVSRQCVWKKQGVQLHKASFFWSETYCVQEVS

SEQ ID NO: 767594 - protein, 254 aa, Homo sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 767595 - protein, 194 aa, Homo sapiens
MDPAASSCMRSLQPPAPVWGCLRNPHSEGNGASGLPHYPPTPFSFHQKPDFLATATAAYPDFSASCLAATPHSLPQEEHIFNETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 767596 - protein, 163 aa, Homo sapiens [sequence omitted]

SEQ ID NO: 767597 - protein, 224 aa, Homo sapiens
ALCRHLLWAPGRTPRQLKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 767598 - protein, 184 aa, Homo sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSGQSVVPEPKDEVEACEGRSAHLPQWAGP

SEQ ID NO: 767599 - protein, 365 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 767600 - protein, 265 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPPALKRLILCAVSLSPFIGDAQRQQPRLEVPQGRVLTVVPGLHLALTAQPLLRSLWRVSDDLGRFSSPS

SEQ ID NO: 767601 - protein, 294 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPPALKRLILCAVSLSPFIGDAQRQQPRLEVLFPFLEEEVTKFEGGRNGHTAKKSPCNSVQDFTGSVTLVEAFMPPHSTALPPMLTLNTGFPLIQTGMS

SEQ ID NO: 767602 - protein, 136 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 767603 - protein, 136 aa, Homo sapiens; identical to SEQ ID NO: 767602

SEQ ID NO: 767604 - protein, 136 aa, Homo sapiens; identical to SEQ ID NO: 767602

SEQ ID NO: 767605 - protein, 136 aa, Homo sapiens; identical to SEQ ID NO: 767602

SEQ ID NO: 767606 - protein, 136 aa, Homo sapiens; identical to SEQ ID NO: 767602

SEQ ID NO: 767607 - protein, 93 aa, Homo sapiens
MPSYSNFPLQVARREFQTSVVSRDIDTAAKFIGAGAATVGVAGSGAGIGTVFGSLIIGYARNPSLKQQLFSYAILGFALSGLVGESGLSGYYV

SEQ ID NO: 767608 - protein, 136 aa, Homo sapiens; identical to SEQ ID NO: 767602

SEQ ID NO: 767609 - protein, 141 aa, Homo sapiens
MGRILRDTCPDVAFRFYRIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 767610 - protein, 136 aa, Homo sapiens; identical to SEQ ID NO: 767602

SEQ ID NO: 767611 - protein, 136 aa, Homo sapiens; identical to SEQ ID NO: 767602

SEQ ID NO: 767612 - protein, 111 aa, Homo sapiens
MNNAPAVLHFFSLHPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 767613 - protein, 136 aa, Homo sapiens; identical to SEQ ID NO: 767602

SEQ ID NO: 767614 - protein, 114 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLNQATLVTELIT

SEQ ID NO: 767615 - protein, 99 aa, Homo sapiens
SSLAHLNLPGWPTLLVHPNPQDLCRLGPLPGVTVPIHLTLLCPPLPSPLPLPQLAMISVPPRNPSLKQQLFSYAILGFALSEAMGLFCLMVAFLILFAM

SEQ ID NO: 767616 - protein, 136 aa, Homo sapiens; identical to SEQ ID NO: 767602

SEQ ID NO: 767617 - protein, 136 aa, Homo sapiens; identical to SEQ ID NO: 767602

SEQ ID NO: 767618 - protein, 136 aa, Homo sapiens; identical to SEQ ID NO: 767602

SEQ ID NO: 767619 - protein, 165 aa, Homo sapiens
PSPVCCLTTDSKTNSQHTLQSEYSAFTRQFANSFRAQVGGVKEVESATCPYAILSLCYLACLASLSSLPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 767620 - protein, 165 aa, Homo sapiens; identical to SEQ ID NO: 767619

SEQ ID NO: 767621 - protein, 98 aa, Homo sapiens
MQTAGALFISPALIRCCTRGLIRPVSASFLIRLREDDRRESTRGRERPSLLGSPCHTQSPTTLNLPSSQFPCRPLEEGRGLGSRTLSCTINKVPCAQP

SEQ ID NO: 767622 - protein, 136 aa, Homo sapiens; identical to SEQ ID NO: 767602

SEQ ID NO: 767623 - protein, 136 aa, Homo sapiens; identical to SEQ ID NO: 767602

SEQ ID NO: 767624 - protein, 136 aa, Homo sapiens; identical to SEQ ID NO: 767602

SEQ ID NO: 767625 - protein, 131 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSGLVGESGLSGYYV

SEQ ID NO: 767626 - protein, 110 aa, Homo sapiens
MQTAGALFISPALPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 767627 - protein, 99 aa, Homo sapiens; identical to SEQ ID NO: 767615

SEQ ID NO: 767628 - protein, 257 aa, Homo sapiens [sequence omitted]

SEQ ID NO: 767629 - protein, 166 aa, Homo sapiens
MKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKP

SEQ ID NO: 767630 - protein, 257 aa, Homo sapiens [sequence omitted]

SEQ ID NO: 767631 - protein, 257 aa, Homo sapiens [sequence omitted]

SEQ ID NO: 767632 - protein, 257 aa, Homo sapiens [sequence omitted]

SEQ ID NO: 767633 - protein, 116 aa, Homo sapiens
MKQRKQQATAIMKEVHGNDVDGMDLGKKVSIPRDIMLEELSHLSNRGARLFKMRQRRSDKYTFENFQYQSRAQINHSIAMQNGKVDGSNLEGGRHPLISTPVRAQPKIPGFGQGIP

SEQ ID NO: 767634 - protein, 101 aa, Homo sapiens
AVPLSQKRQPEGKAELPDYRSFNRVATPFGGFEKASRMVKFKVPDFELLLLTDPRFMSFVNPLSGRRSFNRTPKGWISENIPIVITTEPTDDTTVPESEDL

SEQ ID NO: 767635 - protein, 317 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDRPRWQRLLGEDKFQWLAGLAPPSLFARAMQVLVTAISPGRFPEALDELPLPPFLQPLDLTGKG

SEQ ID NO: 767636 - protein, 317 aa, Homo sapiens; identical to SEQ ID NO: 767635

SEQ ID NO: 767637 - protein, 317 aa, Homo sapiens; identical to SEQ ID NO: 767635

SEQ ID NO: 767638 - protein, 290 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLECCWTSWRCTPPWVPPARPARSCWATGRAGSGCWVRTSSSGWRAWRRPRSSRAPCRCWSPPSLQAASPRPWTSCRCPHSCSRWTSLAKARPGAP

SEQ ID NO: 767639 - protein, 185 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGWGHGGLHRAKGCQVREVSPDPSFIEPPFQAVRWPFNP

SEQ ID NO: 767640 - protein, 83 aa, Homo sapiens
RLSASHGLQEFGTRQRTAIQELFKRISEQFTAMFRRKAFLHWYTGEGMDEMEFTEAESNMNDLVSEYQQYQDATAEEEVRGGG

SEQ ID NO: 767641 - protein, 125 aa, Homo sapiens
MREIVHLQAGQCGNQIGAKFEEVISDEHGIDPTGTYHGDSDLQLERINVYYNEATGGSTAIQELFKRISEQFTAMFRRKAFLHWYTGEGMDEMEFTEAESNMNDLVSEYQQYQDATAEEEVRGGG

SEQ ID NO: 767642 - protein, 83 aa, Homo sapiens; identical to SEQ ID NO: 767640

SEQ ID NO: 767643 - protein, 311 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767644 - protein, 311 aa, Homo sapiens; identical to SEQ ID NO: 767643

SEQ ID NO: 767645 - protein, 311 aa, Homo sapiens; identical to SEQ ID NO: 767643

SEQ ID NO: 767646 - protein, 311 aa, Homo sapiens; identical to SEQ ID NO: 767643

SEQ ID NO: 767647 - protein, 311 aa, Homo sapiens; identical to SEQ ID NO: 767643

SEQ ID NO: 767648 - protein, 432 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 767649 - protein, 311 aa, Homo sapiens; identical to SEQ ID NO: 767643

SEQ ID NO: 767650 - protein, 311 aa, Homo sapiens; identical to SEQ ID NO: 767643

SEQ ID NO: 767651 - protein, 311 aa, Homo sapiens; identical to SEQ ID NO: 767643

SEQ ID NO: 767652 - protein, 311 aa, Homo sapiens; identical to SEQ ID NO: 767643

SEQ ID NO: 767653 - protein, 311 aa, Homo sapiens; identical to SEQ ID NO: 767643

SEQ ID NO: 767654 - protein, 311 aa, Homo sapiens; identical to SEQ ID NO: 767643

SEQ ID NO: 767655 - protein, 363 aa, Homo sapiens
ASLENKEMPLPAPQCARVAAVGQGGASLENKRSISRLSKLESFLREKRETGTGPRHPHTALCTQTGHRRPQFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767656 - protein, 391 aa, Homo sapiens
ELAALRLQNFFPRGDREAPQTLTPDSLEQGQGGTPGSSDPSSSHTSTLWGREGHLLRTKDPFLDFPKLESFLREKRETGTGPRHPHTALCTQTGHRRPQFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767657 - protein, 305 aa, Homo sapiens
LSTLRCLEGGSVQFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767658 - protein, 396 aa, Homo sapiens
MREIVHIQAGQCGNQIGAKFWEVISDEHGIDPSGNYVGDSDLQLERISVYYNEASSDSLDMLPRLVSNSWTQAIHLPWPPKVLGVQTRAPASGGRLTESCLSCSVLSCSVLKHSEAYRVKKVAEACLWSRTLTSEYRLLGSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767659 - protein, 311 aa, Homo sapiens; identical to SEQ ID NO: 767643

SEQ ID NO: 767660 - protein, 393 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAHPAGRCQLASSPQLPGILGWLFGLLALPVGRKVCWSRRADPFTQDPLRRQSLALLGPQVLKTLSRALVLSTQQHRLREATAGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767661 - protein, 130 aa, Homo sapiens
MSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 767662 - protein, 302 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAKWGKITKEMSVLRKEEKKKKKKNIKNKKKKLSLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767663 - protein, 130 aa, Homo sapiens; identical to SEQ ID NO: 767661

SEQ ID NO: 767664 - protein, 130 aa, Homo sapiens; identical to SEQ ID NO: 767661

SEQ ID NO: 767665 - protein, 130 aa, Homo sapiens; identical to SEQ ID NO: 767661

SEQ ID NO: 767666 - protein, 270 aa, Homo sapiens
MASTPAATTWATRTCSWSGSASTTTRPLLTSTCLEPFWWTWNPEPWTVSAQGPLDISSGLTISSLVRVGPATTGPRVTTRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLGRQHGALPAPALLHARLRPPHSPGQPAVPGPDRARAHPADVRCQEHDGRLRPRATAAT

SEQ ID NO: 767667 - protein, 111 aa, Homo sapiens
LKMSSTFIGRPRGGMSHTARGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 767668 - protein, 331 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYWQFPRGKQKTPGKGAPGPLPLNGKPKICFRTLKLATPTYGDLNHLVSATMSGVTTSLRFPGQLNADLRKLGRQHGWAPPFFFFFSPPHPPPPPRGGGGPPGGAPPPPFFGGPQKKPLFSSFSMAPGFAPPH

SEQ ID NO: 767669 - protein, 283 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAGHWRPRERVLWGEQKPLMHFKWNEVYKQTEAYRIARELVRQNGASRGLRGPGARGLAAVKRSGRSHACVLGLGRGCHVPTSVSWGGAVDATFPRLCPGAGPWMPRSHVCVLGRGRGCHVPTPVSWGGAVDATFPRLCPGAGPWMPRSHACVLGRGRGCHVPMPVSWGGAVDATFPCLCPGAGPWTRHRNR

SEQ ID NO: 767670 - protein, 331 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGKFPLLQALMADPITGKPRSVDGDGCEKQGMVSSSHDPEWWELISPFYSWALEAQRKGSVGRTETTHAFQVECSVKQTEAYRIARELVRQNGASRGLRGPGARGLAAVKRSGRSHACVLGLGRGCHVPTSVSWGGAVDATFPRLCPGAGPWMPRSHVCVLGRGRGCHVPTPVSWGGAVDATFPRLCPGAGPWMPRSHACVLGRGRGCHVPMPVSWGGAVDATFPCLCPGAGPWTRHRNR

SEQ ID NO: 767671 - protein, 113 aa, Homo sapiens
MSPSPRWGFLCVLFTAVHPAPSTAPVQDKCPVNTWEAMQASSQQLLQTDPRPKPFLLPPLPPLLLISAGTEVSSLVFQKSPLHTQPEGAIKTAGQPTSVHSKVLSKGSLLLGE

SEQ ID NO: 767672 - protein, 113 aa, Homo sapiens; identical to SEQ ID NO: 767671

SEQ ID NO: 767673 - protein, 87 aa, Homo sapiens
QLGCGRAGVPAPVPIAGQLPHLAPNLGPRGEAQAPGVAGDPRGKWQGQDPGAEPVECHHRPGGDFCVFCSLLYTQPPAQRLSRTSAQ

SEQ ID NO: 767674 - protein, 103 aa, Homo sapiens
SHILLNIILFSGWNVTIAQVGIFVCFVHCCTPSPQHSACPGQVPSKHLGSNASVLPAAPANRPPTQALPSASTATTAAHLCWHRSLFPGLPEIPSPHSARGSY

SEQ ID NO: 767675 - protein, 309 aa, Homo sapiens
GNSSYGRELALSPPELWLWALDKSKAPPPNMDSRYNSTAGIGDLNQLSAAIPATRVEVSVSCRNLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKGVL

SEQ ID NO: 767676 - protein, 328 aa, Homo sapiens
GNSSYGRELALSPPELWLWALDKSKAPPPNMDSRYNSTAGIGDLNQLSAAIPATRVEVSVSCRNLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYESACSSNYLEELRNSSNLKIKHYLSPPNNLLHI

SEQ ID NO: 767677 - protein, 181 aa, Homo sapiens
GNSSYGRELALSPPELWLWALDKSKAPPPNMDSRYNSTAGIGDLNQLSAAIPATRVEVSVSCRNLLDRDTFSKSDPICVLYVQGVGNKEWREFGRTEVIDNTLNPDFVRKFILDYFFEERENLRFDFDDVDSKSPNLSNMTFGQSVCLGEIGYRGSRWKPIVGLLLGPTRIYGIAVLKCIR

SEQ ID NO: 767678 - protein, 535 aa, Homo sapiens
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCHLNFDPNSAPGVARVYDSVQSSGPMVVTSLTEELKKLAKQGWYWGPITRWEAEGKLANVPDGSFLVRDSSDDRYLLSLSFRSHGKTLHTRIEHSNGRFSFYEQPDVEGHTSIVDLIEHSIRDSENGAFCYSRSRLPGSATYPVRLTNPVSRFMQVRSLQYLCRFVIRQYTRIDLIQKLPLPNKMKDYLQEKHY

SEQ ID NO: 767679 - protein, 535 aa, Homo sapiens; identical to SEQ ID NO: 767678

SEQ ID NO: 767680 - protein, 144 aa, Homo sapiens
SPVDPNQRILGVWRWETKDRSRSLEGSPATDPPSGPTGQEREHCRPDFPTMSPCPPSLLLALLTQLCLPLFHSSTLPYMEDKWTPGVLTLLVPAPAYPRCQQTLVHRRLPQLWSQERISLHWMDCILRLKIIFLIFLLISMLSL

SEQ ID NO: 767681 - protein, 156 aa, Homo sapiens
TGQVSAGWDPVPGRRIGAELGISVCTCIAGRRTPRNQGVRQEQPPASSLPVTQEGICAFFPAALGTAELEVLVPGDGGRGYISGHRACPVTHKPRLPSGASGSLWGDHQAGESTTVLAGTTDPSQRVEAGPRLHRGHVGNSGDLRGHLMVALASCH

SEQ ID NO: 767682 - protein, 447 aa, Homo sapiens
AHPPQPPGTKRTAAAALSTCIDHSAPRGSPERTAASAPPLAAPEQSGSGRKHLGSALSGVPSALCSVFLSAWEEEEEEEEEEEEEEEEEEEEEEEEDVWSRLGGGQRQQQQPPPPPPLPPPPERERQESPRLGNPKVSATLHGRLPSSFMGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLTGMTLTYDPTTAAIQNGFYPSPYSIATNRMITQTSITPYIVSPVSA

SEQ ID NO: 767683 - protein, 265 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLTGMTLTYDPTTAAIQNGFYPSPYSIATNRMITQTSITPYIVSPVSA

SEQ ID NO: 767684 - protein, 812 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 767685 - protein, 726 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVMHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 767686 - protein, 902 aa, Homo sapiens
EAEVSVSQDCTSALQPGDRVRLRLKKIPIYLSVYLLLFLPGHFLFVSQEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVFPKRYSSSSGQQLCAALPRGPRVCLWLVEKLPGGVCGQDCDRRGPCLCYFHCRAGASGHCMTHDYHPQDVHFLPRTSTARHTHAFAHSPSSTLTATHTVTQTRSEGGCPLWDGGITSLRTQPSPLGLLGGPSSLRGFGAEEQLFWMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 767687 - protein, 456 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPGGRCS

SEQ ID NO: 767688 - protein, 148 aa, Homo sapiens [sequence omitted]

SEQ ID NO: 767689 - protein, 957 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVFPKRYSSSSGQQLCAALPRGPRVCLWLVEKLPGGVCGQDCDRRGPCLCYFHCRAGASGHCMTHDYTPRMCTFSLAPDTARHTHAFAHSPSSTLTATHTVTQTRSEGGCPLWDGGITSLRTQPSPLGLLGGPSSLRGFGAEEQLFWMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 767690 - protein, 919 aa, Homo sapiens
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVFPKRYSSSSGQQLCAALPRGPRVCLWLVEKLPGGVCGQDCDRRGPCLCYFHCRAGASGHCMTHDYTPRMCTFSLAPDTARHTHAFAHSPSSTLTATHTVTQTRSEGGCPLWDGGITSLRTQPSPLGLLGGPSSLRGFGAEEQLFWMHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 767691 - protein, 494 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 767692 - protein, 205 aa, Homo sapiens
RIPRDPVQLVWGEVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 767693 - protein, 494 aa, Homo sapiens; identical to SEQ ID NO: 767691

SEQ ID NO: 767694 - protein, 494 aa, Homo sapiens; identical to SEQ ID NO: 767691

SEQ ID NO: 767695 - protein, 289 aa, Homo sapiens
EPENLRATAALFTKAPGARGRALPASGKAGRARGSAGGSAARGHWSLARFPAPRGSHLPARRSSGRVSTPILRPVSSIPLALSRESRTAEESSLTPQPQVGLVHIMTSFEDADTEETVTCLQMTVYHPGQLQCGIFQSISFNREKLPSSEVVKFGRNSNICHYTFQDKQVSRVQFSLQLFKKFNSSVLSFEIKNMSKKTNLIVDSRELGYLNKMDLPYRCMVRFGEYQFLMEKEDGESLEFFETQFILSPRSLLQENNWPPHRPIPEYGTYSLCSSQSSSPTEMDENES

SEQ ID NO: 767696 - protein, 289 aa, Homo sapiens; identical to SEQ ID NO: 767695

SEQ ID NO: 767697 - protein, 289 aa, Homo sapiens; identical to SEQ ID NO: 767695

SEQ ID NO: 767698 - protein, 184 aa, Homo sapiens
MTSFEDADTEETVTCLQMTVYHPGQLQCGIFQSISFNREKLPSSEVVKFGRNSNICHYTFQDKQVSRVQFSLQLFKKFNSSVLSFEIKNMSKKTNLIVDSRELGYLNKMDLPYRCMVRFGEYQFLMEKEDGESLEFFETQFILSPRSLLQENNWPPHRPIPEYGTYSLCSSQSSSPTEMDENES

SEQ ID NO: 767699 - protein, 289 aa, Homo sapiens; identical to SEQ ID NO: 767695

SEQ ID NO: 767700 - protein, 154 aa, Homo sapiens
MSGEENPASKPTPVQDVQGDGRWMSLHHRFLADSKDKEPEVVFIGDSLVQLMHQCEIWRESFSPLHALNFGIGGDGTQHVLWRLENGELEHIRPKIVVVWVGTNNHGHTAEQVTGGIKAIVQLVNERQPRPGLWCWACFREANIPTHFGRRTDR

SEQ ID NO: 767701 - protein, 206 aa, Homo sapiens
MSGEENPASKPTPVQDVQGDGRWMSLHHRFLADSKDKEPEVVFIGDSLVQLMHQCEIWRESFSPLHALNFGIGGDGTQHVLWRLENGELEHIRPKIVVVWVGTNNHGHTAEQLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 767702 - protein, 702 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767703 - protein, 295 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATG

SEQ ID NO: 767704 - protein, 702 aa, Homo sapiens; identical to SEQ ID NO: 767702

SEQ ID NO: 767705 - protein, 702 aa, Homo sapiens; identical to SEQ ID NO: 767702

SEQ ID NO: 767706 - protein, 684 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVID

SEQ ID NO: 767707 - protein, 489 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVMVLAPPPQLERRLGRRGPPRSCLFRSYRKR

SEQ ID NO: 767708 - protein, 682 aa, Homo sapiens
GEVQPKPIIDRGVLLSCLAALSVALERLVLDHMVVGQTDVADSRNPRFTDSACGCDAREASAYSFIISISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767709 - protein, 551 aa, Homo sapiens
MEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767710 - protein, 677 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVLENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767711 - protein, 507 aa, Homo sapiens
MPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767712 - protein, 413 aa, Homo sapiens
MLLWGTWRRTTGGGISTTPCSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767713 - protein, 337 aa, Homo sapiens
GRVGSTHASLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767714 - protein, 101 aa, Homo sapiens
LQNLMLCALQTIYGAEARKESRGAHAREDYKVGLLTTPTCTCLFLPPGGTQPHPCIFSAFSFVAPKVNPKNAFFPPGNFDPWVLAIFWITVTFSLLWVGIH

SEQ ID NO: 767715 - protein, 165 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQVRERCPTVLPLRAGPAQPRTFYL

SEQ ID NO: 767716 - protein, 843 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRCCVIYHQHCLSGHTGRGCFCEFQHRSPSPSCAGACAQPPLLAAGRRLLVCDIFLKTYILKILASFFLKSVEQSFSYVCEYVTEYGRERHTPNLKSACEPWVLCLIPTDVFWQLSKCVGYLAFSKTVLQLFHCLTLFFNVMTFAKYLLVWPLEVLHFYIKKTEKSGVSHHAWPTSLSLTCSTDTLLGKVGWWRHGHLTFHLKSSFPQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767717 - protein, 621 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKVRIDEYDYSKPIQGQQKKPFEEHWRKHTLSYVDVGTGKVTLEYRPVIDKTLNEADCATVPPAIRSY

SEQ ID NO: 767718 - protein, 617 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKVRAWTRSGVSRRAAYLALHWFCFLKTRSRGMQVQFCVDVLGGGGVWAFHVPVTQVVCVVPSR

SEQ ID NO: 767719 - protein, 339 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTERH

SEQ ID NO: 767720 - protein, 654 aa, Homo sapiens
PAWCAGAVSPLPRQLDPGVVRRRSLRRDWRDCAAATADMSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQLENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767721 - protein, 523 aa, Homo sapiens
THAVGPPPPWSLENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767722 - protein, 479 aa, Homo sapiens
LGECRGLIGTGPLAYCITLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767723 - protein, 146 aa, Homo sapiens
MQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 767724 - protein, 188 aa, Homo sapiens
MDCRKMVRFSYSVIWIMAISKAFELGLVAGLGHQEFARPSRGDLAFRDDSIWPQEEPAIRPRSSQRVLPMGIQHSKELNRTCCLNGGTCMLESFCACPPSFYGRNCEHDVRKENCGSVPHDTWLPKKCSLCKCWHGQLRCFPQAFLPGCDGLVMDEHLVASRTPELPPSARTTTFMLAGICLSIQSYY

SEQ ID NO: 767725 - protein, 69 aa, Homo sapiens
LLISGRALSLACRSGLGEKAGPARVSTPASWRPASDAQHCDCCTATRLSRCGCMRDLGMCAGVFATATG

SEQ ID NO: 767726 - protein, 184 aa, Homo sapiens
MVRYSLDPENPTKSCKSRGSNLRVHFKNTRETAQAIKGMHIQKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 767727 - protein, 107 aa, Homo sapiens
EDPPSFRSFNSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767728 - protein, 130 aa, Homo sapiens
CVNMRLPYKAAKRLPVGHFLGPASPQEEGGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767729 - protein, 122 aa, Homo sapiens
MPLVLEVSIDFLGPASPQEEGGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767730 - protein, 113 aa, Homo sapiens
RARYHLFDQEEGGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767731 - protein, 113 aa, Homo sapiens
QLVPNEHGQEEGGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767732 - protein, 130 aa, Homo sapiens; identical to SEQ ID NO: 767728

SEQ ID NO: 767733 - protein, 130 aa, Homo sapiens; identical to SEQ ID NO: 767728

SEQ ID NO: 767734 - protein, 114 aa, Homo sapiens
HSRVSPKHSQEEGGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767735 - protein, 153 aa, Homo sapiens
TPLPTSSPNDISYSPTQFSDPSLTNKEASLALLLSILILAIIAGHEISRDRRLYLNMTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 767736 - protein, 331 aa, Homo sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 767737 - protein, 170 aa, Homo sapiens
MDSTLPPGFPEKGLGTAPLSPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 767738 - protein, 331 aa, Homo sapiens; identical to SEQ ID NO: 767736

SEQ ID NO: 767739 - protein, 214 aa, Homo sapiens
MVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 767740 - protein, 164 aa, Homo sapiens
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 767741 - protein, 514 aa, Homo sapiens
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCS

SEQ ID NO: 767742 - protein, 238 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARCGVMLVTRMVLIREKCGVCDIIRMYGEEGIVGFLGGVGAVVRE

SEQ ID NO: 767743 - protein, 367 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767744 - protein, 367 aa, Homo sapiens; identical to SEQ ID NO: 767743

SEQ ID NO: 767745 - protein, 176 aa, Homo sapiens
MIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767746 - protein, 367 aa, Homo sapiens; identical to SEQ ID NO: 767743

SEQ ID NO: 767747 - protein, 155 aa, Homo sapiens
MVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767748 - protein, 282 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767749 - protein, 323 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGSCWWMPSLLPNIYVLDRLLVHATKRGEYEPRK

SEQ ID NO: 767750 - protein, 283 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGGFLSNELK

SEQ ID NO: 767751 - protein, 367 aa, Homo sapiens; identical to SEQ ID NO: 767743

SEQ ID NO: 767752 - protein, 367 aa, Homo sapiens; identical to SEQ ID NO: 767743

SEQ ID NO: 767753 - protein, 321 aa, Homo sapiens
VWIGLVRDWVNRQRAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767754 - protein, 358 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 767755 - protein, 166 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGE

SEQ ID NO: 767756 - protein, 323 aa, Homo sapiens; identical to SEQ ID NO: 767749

SEQ ID NO: 767757 - protein, 170 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYASKHISLTLSLILQEKDSTKEGNMSRGNSLFFRKVPFGKTYCCDLKMLI

SEQ ID NO: 767758 - protein, 209 aa, Homo sapiens
RERLPFLGAGRGGGDWAERRVLLRACARAAGGPVKPAALARDLGPAHRVAWWLRLSVRPPAGAIMADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETERECRGLFPPLGFRKLMRSSA

SEQ ID NO: 767759 - protein, 258 aa, Homo sapiens
APEREPVNALGIMAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 767760 - protein, 110 aa, Homo sapiens
LLDWILSIFLILYHFVFFPIDNLLGISWVDSSWIPILNSGSVLDYFSERSNPFYDRTCNNEVVKMQRLTLEHLNQMVGIEYILLHAQEPILFIIRKQQRQSPAQGKMCKL

SEQ ID NO: 767761 - protein, 195 aa, Homo sapiens
MQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQDKVRPKAKRKEEPSSIFQRQRVDALLLDLRQKFPPKFVQLKPGEKPVPVDQTKKEAEPIPETVKPEEKETTKNVQQTVSAKGPPEKRMRLQ

SEQ ID NO: 767762 - protein, 140 aa, Homo sapiens
APEREPVNALGIMAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVVSVFTFFKH

SEQ ID NO: 767763 - protein, 169 aa, Homo sapiens
APEREPVNALGIMAAVDIRDNLLGISWVDSSWIPILNSGSVLDYFSERSNPFYDRTCNNEVVKMQRLTLEHLNQMVGIEYILLHAQEPILFIIRKQQRQSPAQVIPLADYYIIAGVIYQAPDLGSVINSRVLTAVHGIQSAFDEAMSYCRYHPSKGYWWHFKDHEEQGK

SEQ ID NO: 767764 - protein, 258 aa, Homo sapiens; identical to SEQ ID NO: 767759

SEQ ID NO: 767765 - protein, 140 aa, Homo sapiens; identical to SEQ ID NO: 767762

SEQ ID NO: 767766 - protein, 88 aa, Homo sapiens
QDGRIGTAPVYSSQREQCRRQGLGNCCLWAEFGLLSAFRDQDESEGYGGYFLIQKPEAVLFNEGSGNKACDVISNQSELLNCTSHIQC

SEQ ID NO: 767767 - protein, 116 aa, Homo sapiens
RGRVGHERVAGRRAGVSAGAPEPAAPDGRPQGEVHPDRSRAALPPAGAPGLHPRQKVPAAGPRLPGLRLCRVRAAHRAQHQEPAPVVLQTHPAAHQQVPRTRAEAHPGPAVPASSV

SEQ ID NO: 767768 - protein, 261 aa, Homo sapiens
AGASAMSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDEGRRETTVYRGLVQKRGKKQLGSLKKKFKSHHRKPKSFSSCKQPG

SEQ ID NO: 767769 - protein, 203 aa, Homo sapiens
MKKLNQITNIQRSIGRGKKTITIMRRSLIWNQKLSQIRLPAKKKEKKEKRKPTVAQQVMITKRPKENHQRKRRNVNIKKKAKNPKSPEVQAVKDWANQRCSSPKGSARNSLVKAKRKRSVSVCSKESPSSSSESESCDEAISDGPSTVTLEARNSSEKLPTELSKEGPSTKNTTADKLGIKSGFSLTPSKGKTSGTTSSYFRL

SEQ ID NO: 767770 - protein, 103 aa, Homo sapiens
DSVAGAEGATGRELGDEVQEVVESRSDRAFAFPHGSHRRVLNRGVISSNYSFKAPSGYHERIAHRGARREEGELSRPLLLHIKDERIILIAQPCSICHNMFPF

SEQ ID NO: 767771 - protein, 497 aa, Homo sapiens
PLGGCGWTFTTSYKLKRHLQSHDKLRPFGCPAEGCGKSFTTVYNLKAHMKGHEQENSFKCEVCEESFPTQAKLGAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDTLTPSSTLCENSVSELLTPAKAEWSVHPNSDFFGQEGETQFGFPNAAGNHGSQKERNLITVTGSSFLV

SEQ ID NO: 767772 - protein, 391 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKVKLEPVLTRD

SEQ ID NO: 767773 - protein, 161 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKYPFASNFYK

SEQ ID NO: 767774 - protein, 120 aa, Homo sapiens
GRVGPDAWCRPTRAVRYPLALWEKAAPELPYFRLFHGYQSVQRITKLIKQEPEGKSRCQDNCVIRSKKKRWSLALSPRLEYSGVILAHCNLCLPGSSDSPASASRVAGITGLAEGTVSTD

SEQ ID NO: 767775 - protein, 161 aa, Homo sapiens; identical to SEQ ID NO: 767773

SEQ ID NO: 767776 - protein, 393 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKGDLSFLLSATLP

SEQ ID NO: 767777 - protein, 161 aa, Homo sapiens; identical to SEQ ID NO: 767773

SEQ ID NO: 767778 - protein, 161 aa, Homo sapiens; identical to SEQ ID NO: 767773

SEQ ID NO: 767779 - protein, 74 aa, Homo sapiens
GRVGPDAWCRPTRAVRYPLALWEKAAPELPYFRLFHGYQSVQRITKLIKQEPEGKSRCQDNCVIRSKKKRRQCI

SEQ ID NO: 767780 - protein, 948 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSADLLEIVKDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767781 - protein, 87 aa, Homo sapiens
MLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767782 - protein, 899 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAGRGLRRPAQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767783 - protein, 849 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKVRMKAILKA

SEQ ID NO: 767784 - protein, 323 aa, Homo sapiens
EAHDGALNAVGLFSLMVPFSSDLLNLGVHVLETGAGTPFLGSACSSDGIASQMNTAGLPQVRCTPECSCDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767785 - protein, 691 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDGALLF

SEQ ID NO: 767786 - protein, 691 aa, Homo sapiens; identical to SEQ ID NO: 767785

SEQ ID NO: 767787 - protein, 940 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767788 - protein, 343 aa, Homo sapiens
ADLEDPEAHERRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767789 - protein, 994 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDGALLFLTCCNLGVHVLETGAGTPFLGSACSSDGIASQMNTAGLPQVRCTPECSCDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSG

SEQ ID NO: 767790 - protein, 695 aa, Homo sapiens
MAPRARSASQDRLEEVAAPRPWPCSTSQDALSQLGQEGWHRARSDDYLSRATRSAEALGPGALVSPRFERCGWASQFVPATPRLPNSGLPGPQPNPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDEVGEAGGSVEGGLRWCVGGAPLGEFCGLLCCMHCAL

SEQ ID NO: 767791 - protein, 104 aa, Homo sapiens
NIGRTVPPGDPGSGERRGLGVGRREVGHCIPEGPRCLARCPASLCHPSGALPCRPPWRWGWGGPSPSLGKSSLPRAHLLSAQLPRPGQGRSFVRPLSLVSFLSL

SEQ ID NO: 767792 - protein, 118 aa, Homo sapiens
MKYTFWGWVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHR

SEQ ID NO: 767793 - protein, 710 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKKRKD

SEQ ID NO: 767794 - protein, 861 aa, Homo sapiens
MSGEVRLRQLEQFILDGPAQTNGQYFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRA

SEQ ID NO: 767795 - protein, 627 aa, Homo sapiens
MKYTFWGWVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREG

SEQ ID NO: 767796 - protein, 508 aa, Homo sapiens
SSFRRGWCRRVEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 767797 - protein, 510 aa, Homo sapiens
VPRGSPLFSFYIGEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 767798 - protein, 310 aa, Homo sapiens
SSFRRGWCRRVEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAV

SEQ ID NO: 767799 - protein, 508 aa, Homo sapiens; identical to SEQ ID NO: 767796

SEQ ID NO: 767800 - protein, 508 aa, Homo sapiens; identical to SEQ ID NO: 767796

SEQ ID NO: 767801 - protein, 508 aa, Homo sapiens; identical to SEQ ID NO: 767796

SEQ ID NO: 767802 - protein, 508 aa, Homo sapiens; identical to SEQ ID NO: 767796

SEQ ID NO: 767803 - protein, 508 aa, Homo sapiens; identical to SEQ ID NO: 767796

SEQ ID NO: 767804 - protein, 508 aa, Homo sapiens; identical to SEQ ID NO: 767796

SEQ ID NO: 767805 - protein, 512 aa, Homo sapiens
SSFRRGWCRRVEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSPPRHCPPPT

SEQ ID NO: 767806 - protein, 360 aa, Homo sapiens
SSFRRGWCRRVEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPMTYMGP

SEQ ID NO: 767807 - protein, 139 aa, Homo sapiens
SSFRRGWCRRVEKDRGPRRSVSFPRALSGNMAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGR

SEQ ID NO: 767808 - protein, 84 aa, Homo sapiens [sequence omitted]

SEQ ID NO: 767809 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 767810 - protein, 741 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGLECSGTVLAHCNLRLPDSSSSPASASRVAGISGRLQHK

SEQ ID NO: 767811 - protein, 678 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGRLQHK

SEQ ID NO: 767812 - protein, 662 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACVSNY

SEQ ID NO: 767813 - protein, 814 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMVSFVWIWVPALAMLGAKGLTFHASLIWHLGCIWEIEELKRKEHLGNILNLKSLSAVTQGYTRIMSSIIFNNSIFGQIK

SEQ ID NO: 767814 - protein, 745 aa, Homo sapiens; identical to SEQ ID NO: 767809

SEQ ID NO: 767815 - protein, 564 aa, Homo sapiens
MCKVLFPEISETKLLHMHLIIIVSYEYHGMRMYCWISVFLASSELENPVHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 767816 - protein, 662 aa, Homo sapiens; identical to SEQ ID NO: 767812

SEQ ID NO: 767817 - protein, 321 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKNRHTLNTTSC

SEQ ID NO: 767818 - protein, 66 aa, Homo sapiens
DTEATARPRSAWQRASSQTMALPLDQGALWWPCLGITEASHSCLLVTLLTMSPQLLSLYGLFFPRL

SEQ ID NO: 767819 - protein, 122 aa, Homo sapiens
PFSVTRHSATYKNHSLPKLVIISFLSVVKMSTVQIQCGILKARGHTQGDYGTQVQENRKTVLCYGILIINISSLFTRFKGSSVVTLNQGQVWWLTPVILALSEAKVGGSLELRSFKPSWARE

SEQ ID NO: 767820 - protein, 130 aa, Homo sapiens
ALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKEN

SEQ ID NO: 767821 - protein, 93 aa, Homo sapiens
PFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 767822 - protein, 183 aa, Homo sapiens
MSKGITFSLKDSSHAYGLSGYFSFVLESRGSLLFSRKMSDNPPDPAYARHSGCKTQKACAFSQGVPSHDSGHNPLCPLLSHCPSTPNLPFYALLCDAGTGLCKCHFSFAHWLPLEYSRGCLQTWGIKKEQLLPVCFWLLSGSPQQCSHCLYMPSTSSFSGIVRASFIMPLPSRALADLRGLSI

SEQ ID NO: 767823 - protein, 1295 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767824 - protein, 263 aa, Homo sapiens
MVARLGGLYQPFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVSDRSGFWWPSGGLPRGGVPG

SEQ ID NO: 767825 - protein, 156 aa, Homo sapiens [sequence omitted]

SEQ ID NO: 767826 - protein, 95 aa, Homo sapiens
LKPVARADSLERLCHAERRKDFVSEAYLITLGKFINMFAVLDELKNMKCSVKNDHSAYKRAAQFLRKMADPQSIQESQNLSMFLANHNKITQSLP

SEQ ID NO: 767827 - protein, 1253 aa, Homo sapiens
MAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767828 - protein, 1253 aa, Homo sapiens; identical to SEQ ID NO: 767827

SEQ ID NO: 767829 - protein, 1008 aa, Homo sapiens
MGSEILSSELCRIIHFVAFQVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767830 - protein, 943 aa, Homo sapiens
MSHCAWPRILFKMMMKCQSLRYSALTIQAILPGRFFKREVTGPGSFAHLWRWTVCAPSCVTFRMQQRFEGWPGFGHHRVSQTRSQAFCMQYGTPLLFRPPQYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767831 - protein, 1295 aa, Homo sapiens; identical to SEQ ID NO: 767823

SEQ ID NO: 767832 - protein, 605 aa, Homo sapiens
MAEAAGHTAAVLCRYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767833 - protein, 599 aa, Homo sapiens
KRSCVGKLSVLWLLFEATLAALKQTVGFGKNTPQTGREAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767834 - protein, 902 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTSCPTTATTALPTGLFGQCYHFLRNFKEISSLMHSLSICMDPRL

SEQ ID NO: 767835 - protein, 1295 aa, Homo sapiens; identical to SEQ ID NO: 767823

SEQ ID NO: 767836 - protein, 1277 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVIITILDKYLKSGDGEGTPVEHVRCFQPPIHQSLASS

SEQ ID NO: 767837 - protein, 464 aa, Homo sapiens
MCIERMLWNNTDTRLTATKTGHRDRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767838 - protein, 207 aa, Homo sapiens [sequence omitted]

SEQ ID NO: 767839 - protein, 1244 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMEYVLYSLDLYNDSAHYALTRFNKQFLYDEIEAEVNLCFDQFVYKLADQIFAYYKVMAGSLLLDKRLRSECKNQGATIHLPPSNRYETLLKQRHVQLLGRSIDLNRLITQRVSAAMYKSLELAIGRFESEDLTSIVELDGLLEINRMTHKLLSRYLTLDGFDAMFREANHNVSAPYGRITLHVFWELNYDFLPNYCYNGSTNRFVRTVLPFSQEFQRDKQPNAQPQYLHGSKALNLAYSSIYGSYRNFVGPPHFQVICRLLGYQGIAVVMEELLKVVKSLLQGTILQYVKTLMEVMPKICRLPRHEYGSPGILEFFHHQLKDIVEYAELKTVCFQNLREVGNAILFCLLIEQSLSLEEVCDLLHAAPFQNILPRVHVKEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVVCG

SEQ ID NO: 767840 - protein, 717 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVIAMIKGLQVLMGRMESVFNHAIRHTVYAALQDFSQVTLREPLRQAIKKKKNVIQSVLQAIRKTVCDWETGHEPFNDPALRGEKDPKSGFDIKVPRRAVGPSSTQLYMVRTMLESLIADKSGSKKTLRSSLEGPTILDIEKFHRESFFYTHLINFSETLQQCCDLSQLWFREFFLELTMGRRIQFPIEMSMPWILTDHILETKEASMMECVSCGPVSSLCVW

SEQ ID NO: 767841 - protein, 1295 aa, Homo sapiens; identical to SEQ ID NO: 767823

SEQ ID NO: 767842 - protein, 221 aa, Homo sapiens
MSRACEEGERLDAKMKRLESKYAPLHLVPLIERLGTPQQIAIAREGDLLTKERLCCGLSMFEVILTRIRSFLDDPIWRGPLPSNGVMHVDECVEFHRLWSAMQFVYCIPVGTHEFTVEQCFGDGLHWAGCMIIVLLGQQRRFAVLDFCYHLLKVQKHDGKDEIIKNVPLKKMVERIRKFQILNDEIITILDKYLKSGDGEGTPVEHVRCFQPPIHQSLASS

SEQ ID NO: 767843 - protein, 508 aa, Homo sapiens
PGGRGGGRVFPGAFPASPSDSLGQGNSQGPPRTPKPPRTQPRMAAQVTLEDALSNVDLLEELPLPDQQPCIEPPPSSLLYQPNFNTNFEDRNAFVTGIARYIEQATVHSSMNEMLEEGQEYAVMLYTWRSCSRAIPQVKCNEQPNRVEIYEKTVEVLEPEVTKLMNFMYFQRNAIERFCGEVRRLCHAERRKDFVSEAYLITLGKFINMFAVLDELKNMKCSVKNDHSAYKRAAQFLRKMADPQSIQESQNLSMFLANHNKITQSLQQQLEVISGYEELLADIVNLCVDYYENRMYLTPSEKHMLLKVMGFGLYLMDGSVSNIYKLDAKKRINLSKIDKYFKQLQVVPLFGDMQIELARYIKTSAHYEENKSRWTCTSSGSSPQYNICEQMIQIREDHMRFISELARYSNSEVVTGSGRQEAQKTDAEYRKLFDLALQGLQLLSQWSAHVMEVYSWKLVHPTDKYSNKDCPDSAEEYERATRYNYTSEEKFALVEVRMLGRSLFLMSL

SEQ ID NO: 767844 - protein, 154 aa, Homo sapiens
VNSTDAGRGLASDRDHHAHVTKDVTTVNSSDHSGFSPASLNLTHTGSEDNLIHSVSQQKPEHLRRSRLPNSPGGTDVSHSAQRKLPSLYVRGRHNCAISFLKKFTNICKLSKIISLKLFHKPWNETGRALLRSKGFCYLLVNSNEILLKVKSWN

SEQ ID NO: 767845 - protein, 338 aa, Homo sapiens
MQRRRRSGFSRRPRILLQWRSTFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 767846 - protein, 338 aa, Homo sapiens; identical to SEQ ID NO: 767845

SEQ ID NO: 767847 - protein, 248 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFCCPVY

SEQ ID NO: 767848 - protein, 338 aa, Homo sapiens; identical to SEQ ID NO: 767845

SEQ ID NO: 767849 - protein, 248 aa, Homo sapiens; identical to SEQ ID NO: 767847

SEQ ID NO: 767850 - protein, 338 aa, Homo sapiens; identical to SEQ ID NO: 767845

SEQ ID NO: 767851 - protein, 307 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAGGSTCACYNTPKYRVWELTSKMFQSGWGGPTGAHDSLRLVELQHGRAMGPSHLKTWGRSHRGTPAKPDR

SEQ ID NO: 767852 - protein, 223 aa, Homo sapiens
KGKVGGLGVGRFHHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFCCPVY

SEQ ID NO: 767853 - protein, 236 aa, Homo sapiens
MQRRRRSGFSRRPRILLQWRSTFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPYGRSAHKILLAILGQKEPDEGKSTEGPKSSRWGQSQTWRCA

SEQ ID NO: 767854 - protein, 241 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKNLYYPRKTSPNCKKGKGIVFSKPGKGLPAG

SEQ ID NO: 767855 - protein, 236 aa, Homo sapiens; identical to SEQ ID NO: 767853

SEQ ID NO: 767856 - protein, 207 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIVHIPCRKIKMPRRRL

SEQ ID NO: 767857 - protein, 216 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNHGHILVDYSKNLVTEDVMRMLVDLAKSRGV

SEQ ID NO: 767858 - protein, 142 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDTTQSTLWLWAWTTSP

SEQ ID NO: 767859 - protein, 307 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAGGSTCACYNTPKYRVWELTSKMSSPGWGGPTGAHDSLRLVELQHGRAMGPSHLKTWGRSHRGTPAKPDR

SEQ ID NO: 767860 - protein, 338 aa, Homo sapiens; identical to SEQ ID NO: 767845

SEQ ID NO: 767861 - protein, 338 aa, Homo sapiens; identical to SEQ ID NO: 767845

SEQ ID NO: 767862 - protein, 338 aa, Homo sapiens; identical to SEQ ID NO: 767845

SEQ ID NO: 767863 - protein, 248 aa, Homo sapiens; identical to SEQ ID NO: 767847

SEQ ID NO: 767864 - protein, 235 aa, Homo sapiens
CAPLPVTAPDTLAERLHLVQNLVDLWHHLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFCCPVY

SEQ ID NO: 767865 - protein, 236 aa, Homo sapiens; identical to SEQ ID NO: 767853

SEQ ID NO: 767866 - protein, 231 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKLTTRRHHNAKRKDGQRQDLL

SEQ ID NO: 767867 - protein, 236 aa, Homo sapiens; identical to SEQ ID NO: 767853

SEQ ID NO: 767868 - protein, 338 aa, Homo sapiens; identical to SEQ ID NO: 767845

SEQ ID NO: 767869 - protein, 158 aa, Homo sapiens [sequence omitted]

SEQ ID NO: 767870 - protein, 177 aa, Homo sapiens
MPAWGALFLLWATAEATKDCPSPCTCRALETMGLWVDCRGHGLTALPALPARTRHLLLANNSLQSVPPGAFDHLPQLQTLDVTQNPWHCDCSLTYLRLWLEDRTPEALLQVRCASPSLAAHGPLGRLTGYQLGSCGWQLQASWVRPGVLWDVALVAVAALGLALLAGLLCATTEALD

SEQ ID NO: 767871 - protein, 621 aa, Homo sapiens
AAEQPGNGGGARSPRVSRMASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 767872 - protein, 201 aa, Homo sapiens
MGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKVSGLNDV

SEQ ID NO: 767873 - protein, 621 aa, Homo sapiens; identical to SEQ ID NO: 767871

SEQ ID NO: 767874 - protein, 621 aa, Homo sapiens; identical to SEQ ID NO: 767871

SEQ ID NO: 767875 - protein, 509 aa, Homo sapiens
AAEQPGNGGGARSPRVSRMASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFTFQSFANDAPCANSLLRGDPGTALELEIKAIADFHLGHL

SEQ ID NO: 767876 - protein, 621 aa, Homo sapiens; identical to SEQ ID NO: 767871

SEQ ID NO: 767877 - protein, 967 aa, Homo sapiens
LGYVAERARWGGRFGVKEQTLHKMAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767878 - protein, 953 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767879 - protein, 940 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767880 - protein, 958 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSPSSLPPLDWSRQLSYLSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767881 - protein, 684 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADGCLPAILPGTCPLGHWATRAMAVTISAQ

SEQ ID NO: 767882 - protein, 953 aa, Homo sapiens; identical to SEQ ID NO: 767878

SEQ ID NO: 767883 - protein, 428 aa, Homo sapiens
HFLVSELGHSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767884 - protein, 364 aa, Homo sapiens
MATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767885 - protein, 308 aa, Homo sapiens
GSPAWRFRVADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767886 - protein, 953 aa, Homo sapiens; identical to SEQ ID NO: 767878

SEQ ID NO: 767887 - protein, 292 aa, Homo sapiens
HSFCGADVVSRAACALVPDGCLPVTCLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767888 - protein, 953 aa, Homo sapiens; identical to SEQ ID NO: 767878

SEQ ID NO: 767889 - protein, 202 aa, Homo sapiens
MIEHLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767890 - protein, 953 aa, Homo sapiens; identical to SEQ ID NO: 767878

SEQ ID NO: 767891 - protein, 953 aa, Homo sapiens; identical to SEQ ID NO: 767878

SEQ ID NO: 767892 - protein, 953 aa, Homo sapiens; identical to SEQ ID NO: 767878

SEQ ID NO: 767893 - protein, 783 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGE

SEQ ID NO: 767894 - protein, 953 aa, Homo sapiens; identical to SEQ ID NO: 767878

SEQ ID NO: 767895 - protein, 86 aa, Homo sapiens
SKNRRGRRLSLAHLVSSSADPEGHFETPIWIERVVIIGAGKPAAVVLQTKGSPESRLSFQHDPETSVLVLRKPGINVASDWSIHLR

SEQ ID NO: 767896 - protein, 953 aa, Homo sapiens; identical to SEQ ID NO: 767878

SEQ ID NO: 767897 - protein, 722 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHIHLRTPGNHRALVAPSLSLI

SEQ ID NO: 767898 - protein, 953 aa, Homo sapiens; identical to SEQ ID NO: 767878

SEQ ID NO: 767899 - protein, 953 aa, Homo sapiens; identical to SEQ ID NO: 767878

SEQ ID NO: 767900 - protein, 953 aa, Homo sapiens; identical to SEQ ID NO: 767878

SEQ ID NO: 767901 - protein, 953 aa, Homo sapiens; identical to SEQ ID NO: 767878

SEQ ID NO: 767902 - protein, 945 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKESPQKARLVPFPGIELKNLLLFGFPAAK

SEQ ID NO: 767903 - protein, 183 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVS

SEQ ID NO: 767904 - protein, 124 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARG

SEQ ID NO: 767905 - protein, 313 aa, Homo sapiens
ACSGAGGGAAMKLKLKNVFLAYFLVSIAGLLYALVQLGQPCDCLPPLRAAAEQLRQKDLRISQLQAELRRPPPAPAQPPEPEALPTIYVVTPTYARPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767906 - protein, 276 aa, Homo sapiens
MKYDYGVPRCISVPWLVLESVKSAGPGPVCMSMAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPKRLRAAEKKPGPEGHPTLRAVARLGGPPPA

SEQ ID NO: 767907 - protein, 962 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767908 - protein, 1110 aa, Homo sapiens
MWTLRTDSWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSEYRGWDCREPSVKEHRGVVRSGTGRRRWWDSQVGPGGWEKLSVREGRNQTRVRFFPFPVQTRRQSLLSLSCTLGISGRPAWVCVSFFPFSHHHISQIYFLRFYLFIFFGFFFPPSLEVCRLKLTFMFLFLCWFCASFSPSLPISSCPSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767909 - protein, 402 aa, Homo sapiens [sequence omitted]

SEQ ID NO: 767910 - protein, 424 aa, Homo sapiens
RIPRKQLTIMTGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767911 - protein, 936 aa, Homo sapiens
RLYRPGMLGCGGSGSGGAYEGWSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKVVLRKPGINVASDWSIHLR

SEQ ID NO: 767912 - protein, 311 aa, Homo sapiens
MGKSWYQRSGRGEEITRGIWSPGSALSSCPKCWQNLGLRLAEVKSGEGRTPRQKKEISQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767913 - protein, 226 aa, Homo sapiens
IELGTVTFVPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767914 - protein, 953 aa, Homo sapiens; identical to SEQ ID NO: 767878

SEQ ID NO: 767915 - protein, 953 aa, Homo sapiens; identical to SEQ ID NO: 767878

SEQ ID NO: 767916 - protein, 116 aa, Homo sapiens
GCESDEEPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 767917 - protein, 131 aa, Homo sapiens
MGAVPEAASCGSGSVAETREGRCGVRLCKLGRPGMDSSSSSSAAGLGAVDPQLQHFIEVETQKQRFQQLVHQMTELCWEKCMDKPGPKLDSRAEACFVNCVERFIDTSQFILNRLEQTQKSKPVFSESLSD

SEQ ID NO: 767918 - protein, 112 aa, Homo sapiens
MDSSSSSSAAGLGAVDPQLQHFIEVETQKQRFQQLVHQMTELCWRWDLVMLPRLECSGTIMSSISHFQHWTDFPDRKINKEMSDLICTIEKVNLIDIYRTFHPTAAKYTFFS

SEQ ID NO: 767919 - protein, 97 aa, Homo sapiens
RSFWCSLHCSVSSAPRGPASVASLPAGIGRSTAKTPGPTGSLEMVRVPGPTSRERGRGWLELVGSGCGGTLASPQLAPKSAAPSSPWRSSALSPLQP

SEQ ID NO: 767920 - protein, 100 aa, Homo sapiens
NLEGQFGLVKVPLYRPCQLASEPKCKLNAVTVWKSHYYLLSFQNVCRKVRERGALEVQSQQRLWQICLRQQYRHQMVRRGLGERLTPWSGTPVGNVWLCL

SEQ ID NO: 767921 - protein, 69 aa, Homo sapiens
QAGTGPGIYGLCPLRYPSAYESSPGTELRECGLCRSGQEFADCRRPANRQDVLSGVVPSSTASGSSHPI

SEQ ID NO: 767922 - protein, 92 aa, Homo sapiens
LGRGRWYSAEVVPCGTRPHTNLAREPSCGSAVCAVPARSLPTADVLRTVDQSSCPTTDKGSPKDPWKAGPWHKNCLHPSPGASVEEMHQHLA

SEQ ID NO: 767923 - protein, 767 aa, Homo sapiens
LPLSSASPFVPCGTRPHTNLAREPSCGSAVCAVPARSLPTADVLRTGKMCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNWSSCCLRVFAWHPHTNKFAVALLDDSVRVYNASSTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHPSFNKGALLSVGWSTGRIAHIPLYFVNAQFPRFSPVLGRAQEPPAGGGGSIHDLPLFTETSPTSAPWDPLPGPPPVLPIPISLQIISSFVSKKTNKRHMCAAEPESSNTRLSAGPRVSQGTVQNTATRRLHKTPADRDHKAGTATRQDKIHDATPHTERASASPAPPKGAKNENESEPGRTTERRPKEAEGRAQSTATTTRRRRGQTRRAREKRGHTQERAREAEKEGRKAAKETESKKSGSQHKERERNRASNKQTK

SEQ ID NO: 767924 - protein, 67 aa, Homo sapiens
TSVEFRLAVCPLRYPSAYESSPGTELRECGLCRSGQEFADCRRPANRQDVLSGVVPSSTASGSSHPI

SEQ ID NO: 767925 - protein, 69 aa, Homo sapiens
SRSRPVVIGRGCPLRYPSAYESSPGTELRECGLCRSGQEFADCRRPANRQDVLSGVVPSSTASGSSHPI

SEQ ID NO: 767926 - protein, 110 aa, Homo sapiens
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEAQERRSDR

SEQ ID NO: 767927 - protein, 67 aa, Homo sapiens; identical to SEQ ID NO: 767924

SEQ ID NO: 767928 - protein, 69 aa, Homo sapiens; identical to SEQ ID NO: 767925

SEQ ID NO: 767929 - protein, 490 aa, Homo sapiens
LPLSSASPFVPCGTRPHTNLAREPSCGSAVCAVPARSLPTADVLRTGKMCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNWSSCCLRVFAWHPHTNKFAVALLDDSVRVYNASSTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGKGAYPGLYPFVYPNGCAYSKDMPWVHRWFHQLILLNVLIDTGPVF

SEQ ID NO: 767930 - protein, 414 aa, Homo sapiens
LPLSSASPFVPCGTRPHTNLAREPSCGSAVCAVPARSLPTADVLRTGKMCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNWSSCCLRVFAWHPHTNKFAVALLDDSVRVYNASSTIVPSLKHRLQRNVASLAWKPLSASVLAVACQSCILIWTLDPTSLSTRPSSGCAQVLSHPGHTPVTSLAWAPSGGRLLSASPVDAAIRLWDVITETVSPSWFERWVATVLVPEEKSGTSKGLRLEAMDWRGNHKGKVGTKSAGWRKPENRYTGGEGEEQGLNNLGGEQRGGHREEEKSAVLHTV

SEQ ID NO: 767931 - protein, 69 aa, Homo sapiens; identical to SEQ ID NO: 767925

SEQ ID NO: 767932 - protein, 69 aa, Homo sapiens; identical to SEQ ID NO: 767925

SEQ ID NO: 767933 - protein, 115 aa, Homo sapiens
WGFQELDGEAEGLGCCMALPGGPSLGPDSDPFLSLLCRAGPQAELPTSRCTLSMPSFHVLAQCLGGPRNPLLGVEALFMTCPSLLRHPQPLPLGTLSQGHHLFCPTPHIPTSKNK

SEQ ID NO: 767934 - protein, 67 aa, Homo sapiens; identical to SEQ ID NO: 767924

SEQ ID NO: 767935 - protein, 69 aa, Homo sapiens; identical to SEQ ID NO: 767925

SEQ ID NO: 767936 - protein, 69 aa, Homo sapiens; identical to SEQ ID NO: 767925

SEQ ID NO: 767937 - protein, 69 aa, Homo sapiens; identical to SEQ ID NO: 767925

SEQ ID NO: 767938 - protein, 67 aa, Homo sapiens; identical to SEQ ID NO: 767924

SEQ ID NO: 767939 - protein, 258 aa, Homo sapiens
LPLSSASPFVPCGTRPHTNLAREPSCGSAVCAVPARSLPTADVLRTGKMCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNWSSCCLRVFAWHPHTNKFAVALLDDSVRVYNASRCVWGHQVGSDLSISPSLASLGSGESCSS

SEQ ID NO: 767940 - protein, 104 aa, Homo sapiens
LFLLSEAFPSAFQPAACDIACIFLWVIHRPGRINLWINLPVLQLTKDPLKTPGRLDHGTRTAFIHHREQVWKRCINIWRDVGLFGVLNEIANSEEEAQERRSDR

SEQ ID NO: 767941 - protein, 92 aa, Homo sapiens; identical to SEQ ID NO: 767922

SEQ ID NO: 767942 - protein, 142 aa, Homo sapiens
MGQQCFGIYMAAMVPFLCCLPGCLQAKQGIADNRVSDCERNLQKCAWVRTQTLFWLCPSAVSPWAYTCYQLGLGPQWGAAALSFTRGCCYPGMGCLNRDLCPPSLVSRRWGDQPALVPRRQQNPGYHSFSCLSSLGGPDVDL

SEQ ID NO: 767943 - protein, 69 aa, Homo sapiens; identical to SEQ ID NO: 767925

SEQ ID NO: 767944 - protein, 801 aa, Homo sapiens
MDEDEFELQPQEPNSFFDGIGADATHMDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 767945 - protein, 517 aa, Homo sapiens
MDPCKVDSTCPEVIKVYIFKADPGEDDLGGTVDIVESEPENDHGVELLDQNSSIRVPREKMVYMTVNDSQQEDEDLSNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 767946 - protein, 113 aa, Homo sapiens
EEANGCPRIPSRICSSWISEKENGNIKIITGPQERTWRWGWHLLPGSGWLGEWQAISSMKPALTTPALSYMPQPQNRRGPGLGKCPSSSQVRGTRHPPRWAAAFTCIATFFSW

SEQ ID NO: 767947 - protein, 287 aa, Homo sapiens
ADLLGINGTGEERLPQDLKVSTDKEGGVQDLLLPEDMLSGEEYECVSPDDISLPPLPGSPESPLAPSDMEVEEPVSSSLSLHISSYGVQAGTSSPGDAQESVLPPPVAFADACNDKRETFSSHFERPYLQFKAEPPLTSRGFVEKSTALHRISAEHPESMMSEVHERALQQHPQAQGGLLETREKMHADNNFTKTQDRLHASSDAFSGLRFQSGTSRGYQRQMVPREEIKSTSAKSSVVSLADQAPNFSRLLSNVTVMEGSPVTLEVEVTGFPEPTLTWWVAYNDKP

SEQ ID NO: 767948 - protein, 137 aa, Homo sapiens
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMRMKEFERERRLLQRKKRREKKAAELAKGQGPGEVDPKVAL

SEQ ID NO: 767949 - protein, 137 aa, Homo sapiens; identical to SEQ ID NO: 767948

SEQ ID NO: 767950 - protein, 137 aa, Homo sapiens; identical to SEQ ID NO: 767948

SEQ ID NO: 767951 - protein, 137 aa, Homo sapiens; identical to SEQ ID NO: 767948

SEQ ID NO: 767952 - protein, 137 aa, Homo sapiens; identical to SEQ ID NO: 767948

SEQ ID NO: 767953 - protein, 137 aa, Homo sapiens; identical to SEQ ID NO: 767948

SEQ ID NO: 767954 - protein, 137 aa, Homo sapiens; identical to SEQ ID NO: 767948

SEQ ID NO: 767955 - protein, 137 aa, Homo sapiens; identical to SEQ ID NO: 767948

SEQ ID NO: 767956 - protein, 140 aa, Homo sapiens
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMLMKEFERERVLLQKRSGRRRRLLNCQRHGPGDPNPRLAWGGPP

SEQ ID NO: 767957 - protein, 618 aa, Homo sapiens
HWVIDFYAPWCGPCQNFAPEFELLARMIKGKVKAGKVDCQAYAQTCQKAGIRAYPTVKFYFYERAKRNFQEEGGGGAPPKNPSCRRVAVSLPSGDTTRWASQRQQQPLPMDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIGAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 767958 - protein, 509 aa, Homo sapiens
MDPPRASHLSPRKKRPRQTGALMASSPQDIKFQDLVVFILEKKMGTTRRAFLMELARRKGFRVENELSDSVTHIVAENNSGSDVLEWLQAQKVQVSSQPELLDVSWLIECIGAGKPVEMTGKHQLVVRRDYSDSTNPGPPKTPPIAVQKISQYACQRRTTLNNCNQIFTDAFDILAENCEFRENEDSCVTFMRAASVLKSLPFTIISMKDTEGIPCLGSKVKGIIEEIIEDGESSEVKAVLNDERYQSFKLFTSVFGVGLKTSEKWFRMGFRTLSKVRSDKSLKFTRMQKAGFLYYEDLVSCVTRAEAEAVSVLVKEAVWAFLPDAFVTMTGGFRRGKKMGHDVDFLITSPGSTEDEEQLLQKVMNLWEKKGLLLYYDLVESTFEKLRLPSRKVDALDHFQKCFLIFKLPRQRVDSDQSSWQEGKTWKAIRVDLVLCPYERRAFALLGWTGSRQFERDLRRYATHERKMILDNHALYDKTKRIFLKAESEEEIFAHLGLDYIEPWERNA

SEQ ID NO: 767959 - protein, 130 aa, Homo sapiens
GRWLVDTGGHRGYVPAGKLQLYHVVPSAEELRRQAGLNKDPRCLTPEPSPALVPSIPTMNQVIAAYPFVARSSHEVSLQAGQPVTILEAQDKKGNPEWSLVEVNGQRGYVPSGFLARARSPVLWGWSLPS

SEQ ID NO: 767960 - protein, 2418 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLELLHLQLICRDTEDEEAWIQETEPSATSTYLGKDLIASKKLLNRHRVILDNIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNARWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESRMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIERSCDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 767961 - protein, 108 aa, Homo sapiens
LPFLSCDSCSGPPCPGLTFWMAYFLDGSLLKETGTLESQLEANKRKQKEIQAMKRQLTKIVDLGDNLEDALILDIKYSTIGLAQQWDQLYQLGLRMQHNLEQQIQAKY

SEQ ID NO: 767962 - protein, 2040 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLELLHLQLICRDTEDEEAWIQETEPSATSTYLGKDLIASKKLLNRHRVILDNIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNARWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESRMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIERSCDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKV

SEQ ID NO: 767963 - protein, 2263 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLELLHLQLICRDTEDEEAWIQETEPSATSTYLGKDLIASKKLLNRHRVILDNIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNARWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESRMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIERSCDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKY

SEQ ID NO: 767964 - protein, 358 aa, Homo sapiens
MEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 767965 - protein, 1671 aa, Homo sapiens
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLELLHLQLICRDTEDEEAWIQETEPSATSTYLGKDLIASKKLLNRHRVILDNIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNARWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESRMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIERSCDGNEEAMKEQLEQLKEHWDHLLERTNDKGKKLNEASRQQRFNTSIRDFEFWLSEAETLLAMKDQARDLASAGNLLKKHQLLEREMLAREVSSVGIPLLWAE

SEQ ID NO: 767966 - protein, 198 aa, Homo sapiens
RERRERPLASALGKPVYAPKMSKTGTKITFYEDKNFQGRRYDCDCDCADFHTYLSRCNSIKVEGGTWAVYERPNFAGYMYILPQGEYPEYQRWMGLNDRLSSCRAVHLPSGGQYKIQIFEKGDFSGQMYETTEDCPSIMEQFHMREIHSCKVLEGVWIFYELPNYRGRQYLLDKKEYRKPIDWGAASPAVQSFRRIVE

SEQ ID NO: 767967 - protein, 198 aa, Homo sapiens; identical to SEQ ID NO: 767966

SEQ ID NO: 767968 - protein, 120 aa, Homo sapiens
MYILPQGEYPEYQRWMGLNDRLSSCRAVHLPSGGQYKIQIFEKGDFSGQMYETTEDCPSIMEQFHMREIHSCKVLEGVWIFYELPNYRGRQYLLDKKEYRKPIDWGAASPAVQSFRRIVE

SEQ ID NO: 767969 - protein, 129 aa, Homo sapiens
KKKKKKETSFSLICACQKWQRSRKPPQTSVRPGQVCNRHQRLGGSWFCSPVPGRRKNPFTGENTETQSVLALITYLEGGRKGLCMQACLNLKQILSHCSGGVLSEPKTSCTSSPTYLYRSGRQGLPAAG

SEQ ID NO: 767970 - protein, 700 aa, Homo sapiens
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTLQNHAF

SEQ ID NO: 767971 - protein, 123 aa, Homo sapiens
CEFDYLRKRRKSQTLSPVTSSSVASQSCLRKRMPWYLSVIHEKVLAEGVQIPAPHPSLCVRLGGQPCSLTGSGSSIWLAASSRSPWPKMTSRPPALTKLLTPVHPHPSGWQLRRHGTQTHRHA

SEQ ID NO: 767972 - protein, 212 aa, Homo sapiens [sequence omitted]

SEQ ID NO: 767973 - protein, 252 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGGGHQAARHHLHRSQVRWHPGHGLPPHLRQQRAARLRQPDAAEAGGPEHLLLLPEQDTNGQPGVSCYTVSGTE

SEQ ID NO: 767974 - protein, 68 aa, Homo sapiens
MKTIPISPSNPPSIHCKLLDIACWIHHKYNSDKSSTYVKNGTSFDIHYGSGSLSGYLSQDTVSVSPSG

SEQ ID NO: 767975 - protein, 212 aa, Homo sapiens [sequence omitted]

SEQ ID NO: 767976 - protein, 212 aa, Homo sapiens [sequence omitted]

SEQ ID NO: 767977 - protein, 212 aa, Homo sapiens [sequence omitted]

SEQ ID NO: 767978 - protein, 212 aa, Homo sapiens [sequence omitted]

SEQ ID NO: 767979 - protein, 212 aa, Homo sapiens [sequence omitted]

SEQ ID NO: 767980 - protein, 212 aa, Homo sapiens [sequence omitted]

SEQ ID NO: 767981 - protein, 212 aa, Homo sapiens [sequence omitted]

SEQ ID NO: 767982 - protein, 212 aa, Homo sapiens [sequence omitted]

SEQ ID NO: 767983 - protein, 212 aa, Homo sapiens [sequence omitted]

SEQ ID NO: 767984 - protein, 428 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGGGHQAARHHLHRSQVRWHPGHGLPPHLRQQRAARLRQPDAAEAGGPEHLLLLPEQDPDAQPGGELMLGGYRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 767985 - protein, 212 aa, Homo sapiens [sequence omitted]

SEQ ID NO: 767986 - protein, 212 aa, Homo sapiens [sequence omitted]

SEQ ID NO: 767987 - protein, 212 aa, Homo sapiens [sequence omitted]

SEQ ID NO: 767988 - protein, 212 aa, Homo sapiens [sequence omitted]

SEQ ID NO: 767989 - protein, 212 aa, Homo sapiens [sequence omitted]

SEQ ID NO: 767990 - protein, 212 aa, Homo sapiens [sequence omitted]

SEQ ID NO: 767991 - protein, 357 aa, Homo sapiens
MAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 767992 - protein, 357 aa, Homo sapiens; identical to SEQ ID NO: 767991

SEQ ID NO: 767993 - protein, 184 aa, Homo sapiens
MAQDAIEDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 767994 - protein, 243 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGGGHQAARHHLHRSQVRWHPGHGLPPHLRQQRAARLRQPDAAEAGGPEHLLLLPEQGPRCAAWG

SEQ ID NO: 767995 - protein, 243 aa, Homo sapiens; identical to SEQ ID NO: 767994

SEQ ID NO: 767996 - protein, 198 aa, Homo sapiens
MLGGTDSKYYKGSLSYLNVTRKAYWQVHLDQVEVASGLTLCKEGCEAIVDTGTSLMVGPVDEVRELQKAIGAVPLIQGEVSAGGWGWGWGWQGEPQGHHYHPDTAVTPLQYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 767997 - protein, 70 aa, Homo sapiens
KARYETAVKFGRGLKVSQAGKTLCLSGFMGMDIPPPSGPLWILGDVFIGRYYTVFDRDNNRVGFAEAARL

SEQ ID NO: 767998 - protein, 73 aa, Homo sapiens
GYRSLGGKATAVQRLHAQVSQAGKTLCLSGFMGMDIPPPSGPLWILGDVFIGRYYTVFDRDNNRVGFAEAARL

SEQ ID NO: 767999 - protein, 142 aa, Homo sapiens
PHDQWWGTRQGGLRRGCPPLVPKASARQHRNRGESQSRRPLAQRPLPHTPTHSPAHCPGRPGSRRPKPDLLFCSVVFPSLGSEMLPACLSLHLFGGGRADPEHRSVSCIGRPHPSLAAELVYPGAPFISRESPPRPYQRPLG

SEQ ID NO: 768000 - protein, 258 aa, Homo sapiens [sequence omitted]

SEQ ID NO: 768001 - protein, 277 aa, Homo sapiens
GFRVRHRQADRTPSRTGLPDRKEGCGDTGGQLRVAEEKGVSWEDGAWREMREGKRGPPCILSFRGTLERVEAQWELEAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 768002 - protein, 134 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWNPTNKVTNKRTKSKQP

SEQ ID NO: 768003 - protein, 258 aa, Homo sapiens [sequence omitted]

SEQ ID NO: 768004 - protein, 292 aa, Homo sapiens
GFRVRHRQADRTPSRTGLPDRKEGCGDTGGQLRVAEEKGVSWEDGAWREMREGKRGPPCILSFRGTLERVEAQWELEVGPLGGGSVDRQRPAGRRKDARTEAQGVRPRAEESLVGEEAPSGGLRQTRMGLGAAEPRPQTPRRAPHGSWERGVAQSASDLVPRWRSVHFTACYCASMYGPGVRGSGQVCALGVPRLEVGGGAHELETPHLCRFLVLVAEPASPCVGSCLLVNGSERARGCAPGSGEPAVQPAVEPWRCPWRYRVSAGAVGRCFGRSASSAGWRLRQRRCGSGA

SEQ ID NO: 768005 - protein, 310 aa, Homo sapiens
FGRVGRCLGPCAFLLAGVVFTAVFRGVAGLSRYRRRFVVTVGVSVCVLAVFPSWCWTFDVVCRVVPGGTCVRGCSLVSCLGVWCVDGEVLPGPARGLVFGPSRPSRSVRARLEFRTAGFVSELFACNKLKLHRVFSSACVMPASSRGRSISLVKSKAWPSGPSHTHPHTRPPTVLGALEAGGPSPTCCFVLWFSPPWVQKCCLPVCLSICLVGVELIQSTDLFRALEDPTQAWQPSSCILGLPSSPGSPLPGPTSARWAEPLPHTRPSSRALPWKPALPEGPSAQLGPSWALPPYLFSVPGPLRMRPLEA

SEQ ID NO: 768006 - protein, 102 aa, Homo sapiens
SSWSRPQSLACTDLFRALEDPTQAWQPSSCILGLPSSPGSPLPGPTSARWAEPLPHTRPSSRALPWKPALPEGPSAQLGPSWALPPYLFSVPGPLRMRPLEA

SEQ ID NO: 768007 - protein, 212 aa, Homo sapiens [sequence omitted]

SEQ ID NO: 768008 - protein, 212 aa, Homo sapiens [sequence omitted]

SEQ ID NO: 768009 - protein, 212 aa, Homo sapiens [sequence omitted]

SEQ ID NO: 768010 - protein, 212 aa, Homo sapiens [sequence omitted]

SEQ ID NO: 768011 - protein, 212 aa, Homo sapiens [sequence omitted]

SEQ ID NO: 768012 - protein, 212 aa, Homo sapiens [sequence omitted]

SEQ ID NO: 768013 - protein, 212 aa, Homo sapiens [sequence omitted]

SEQ ID NO: 768014 - protein, 212 aa, Homo sapiens [sequence omitted]

SEQ ID NO: 768015 - protein, 212 aa, Homo sapiens [sequence omitted]

SEQ ID NO: 768016 - protein, 212 aa, Homo sapiens [sequence omitted]

SEQ ID NO: 768017 - protein, 212 aa, Homo sapiens [sequence omitted]

SEQ ID NO: 768018 - protein, 280 aa, Homo sapiens
MGGADAHPLVGGADSNPSGGWCLAQCPASQRRQPLPWAVSKWRGRSLGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 768019 - protein, 212 aa, Homo sapiens [sequence omitted]

SEQ ID NO: 768020 - protein, 212 aa, Homo sapiens [sequence omitted]

SEQ ID NO: 768021 - protein, 212 aa, Homo sapiens [sequence omitted]

SEQ ID NO: 768022 - protein, 252 aa, Homo sapiens
LCLCVVLVVDPAMRRPAVCSGWRGPTGLEEPVSKTTVKHWGGVPMPISTSVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 768023 - protein, 190 aa, Homo sapiens
MSSEMLVLIRTRQDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 768024 - protein, 186 aa, Homo sapiens
HQLGPWLAEDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 768025 - protein, 243 aa, Homo sapiens; identical to SEQ ID NO: 767994

SEQ ID NO: 768026 - protein, 110 aa, Homo sapiens
RRHPGYKRTARQNLSVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 768027 - protein, 67 aa, Homo sapiens
PRAAGIRHGTLKVSQAGKTLCLSGFMGMDIPPPSGPLWILGDVFIGRYYTVFDRDNNRVGFAEAARL

SEQ ID NO: 768028 - protein, 84 aa, Homo sapiens
FLRIGFPGLRDLERVVLWGQLVAVPPSFSVSQAGKTLCLSGFMGMDIPPPSGPLWILGDVFIGRYYTVFDRDNNRVGFAEAARL

SEQ ID NO: 768029 - protein, 199 aa, Homo sapiens
MQPSSLLPLALCLLAAPASALVRIPLHKFTSIRRTMSEVGGSVEDLIAKGPVSKYSQAVPAVTEGPIPEVLKNYMDLVPKASARQHRNRGESQSRRPLAQRPLPHTPTHSPAHCPGRPGSRRPKPDLLFCSVVFPSLGSEMLPACLSLHLFGGGRADPEHRSVSCIGRPHPSLAAELVYPGAPFISRESPPRPYQRPLG

SEQ ID NO: 768030 - protein, 314 aa, Homo sapiens
GFRVRHRQADRTPSRTGLPDRKEGCGDTGGQLRVAEEKGVSWEDGAWREMREGKRGPPCILSFRGTLERVEAQWELEVGPLGGGSVDRQRPAGRRKDARTEAQGVRPRAEESLVAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 768031 - protein, 216 aa, Homo sapiens
CWPVGRAQLALTFSLQAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 768032 - protein, 143 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVRRPSGPVRSEEERQPGERRGRQASRSSLFTSLFPSQQEIEEGTGPSGP

SEQ ID NO: 768033 - protein, 859 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTE

SEQ ID NO: 768034 - protein, 817 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKSNGLSHSWSERIPDTKHISDICENGRPRSNSWQGNLGGNKKKIRGKRFRPRSNSTE

SEQ ID NO: 768035 - protein, 906 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 768036 - protein, 870 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 768037 - protein, 899 aa, Homo sapiens [sequence omitted]

SEQ ID NO: 768038 - protein, 887 aa, Homo sapiens
MQAAVAVSVPFLLLCVLGTCPPARCGQAGDASLMELEKRKENRFVERQSIVPLRLIYRSGGEDESRHDALDTRVRGDLGGPQIQMFLKSESQKTIYQIQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 768039 - protein, 278 aa, Homo sapiens
MDTGDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 768040 - protein, 438 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 768041 - protein, 438 aa, Homo sapiens; identical to SEQ ID NO: 768040

SEQ ID NO: 768042 - protein, 438 aa, Homo sapiens; identical to SEQ ID NO: 768040

SEQ ID NO: 768043 - protein, 438 aa, Homo sapiens; identical to SEQ ID NO: 768040

SEQ ID NO: 768044 - protein, 438 aa, Homo sapiens; identical to SEQ ID NO: 768040

SEQ ID NO: 768045 - protein, 138 aa, Homo sapiens [sequence omitted]

SEQ ID NO: 768046 - protein, 438 aa, Homo sapiens; identical to SEQ ID NO: 768040

SEQ ID NO: 768047 - protein, 233 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLVSKMFTFLKLY

SEQ ID NO: 768048 - protein, 376 aa, Homo sapiens
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKREEAERGSLGAGSLCRRRRALGALRDEGPRRRAHLDIGLPRDFRPVSSIIDVDLVPETHRRVRLHRHGCEKPLGFYIRDGASVRVTPHGLEKVPGIFISRMVPGGLAESTGLLAVNDEVLEVNGIEVAGKTLDQVTDMMIANSHNLIVTVKPANQRNNVVRGGRALGSSGPPSDGTAGFVGPPAPRVLQNFHPDEAESDEDNDVVIEGTLEPARPPQTPGAPAGSLSRVNGAGLAQRLQRDLALDGGLQRLLSSLRADPRHSLALPPGGVEEHGPAVTL

SEQ ID NO: 768049 - protein, 299 aa, Homo sapiens
MTAEGSGGARLCVPSNCPLSPEEAERGSLGAGSLCRRRRALGALRDEGPRRRAHLDIGLPRDFRPVSSIIDVDLVPETHRRVRLHRHGCEKPLGFYIRDGASVRVTPHGLEKVPGIFISRMVPGGLAESTGLLAVNDEVLEVNGIEVAGKTLDQVTDMMIANSHNLIVTVKPANQRNNVVRGGRALGSSGPPSDGTAGFVGPPAPRVLQNFHPDEAESDEDNDVVIEGTLEPARPPQTPGAPAGSLSRVNGAGLAQRLQRDLALDGGLQRLLSSLRADPRHSLALPPGGVEEHGPAVTL

SEQ ID NO: 768050 - protein, 107 aa, Homo sapiens
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKRDDGALRPGT

SEQ ID NO: 768051 - protein, 102 aa, Homo sapiens
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKRGGEH

SEQ ID NO: 768052 - protein, 818 aa, Homo sapiens [sequence omitted]

SEQ ID NO: 768053 - protein, 157 aa, Homo sapiens
ICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTAIAVYFSPSSPHMPESDTLSTIMYSMVA

SEQ ID NO: 768054 - protein, 180 aa, Homo sapiens
MALTQGQVTFRDVAIEFSQEEWTCLDPAQRTLYRDVMLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEPDKKRCKKQAY

SEQ ID NO: 768055 - protein, 177 aa, Homo sapiens
IQEYQFLDQEDWGPQRTSKEIRQLQNDCMRLRESLNTTQVHNLALGEKLQNLPTLLYKSLKEGAQAIQEEAQAIQDEVKALQEESQACRRWLCSGVRAAMAAGREEAAAPCCSLELSLPAVTQTPGRQVSSSSCLTCPTTTETRVRPGRPQARGRTPPREAAPSASSSLDPRNKLGS

SEQ ID NO: 768056 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 768057 - protein, 310 aa, Homo sapiens; identical to SEQ ID NO: 768056

SEQ ID NO: 768058 - protein, 310 aa, Homo sapiens; identical to SEQ ID NO: 768056

SEQ ID NO: 768059 - protein, 310 aa, Homo sapiens; identical to SEQ ID NO: 768056

SEQ ID NO: 768060 - protein, 305 aa, Homo sapiens
AETRPSLYSYHILILFQQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 768061 - protein, 310 aa, Homo sapiens; identical to SEQ ID NO: 768056

SEQ ID NO: 768062 - protein, 154 aa, Homo sapiens [sequence omitted]

SEQ ID NO: 768063 - protein, 154 aa, Homo sapiens [sequence omitted]

SEQ ID NO: 768064 - protein, 150 aa, Homo sapiens
EDLGAFPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 768065 - protein, 310 aa, Homo sapiens; identical to SEQ ID NO: 768056

SEQ ID NO: 768066 - protein, 310 aa, Homo sapiens; identical to SEQ ID NO: 768056

SEQ ID NO: 768067 - protein, 310 aa, Homo sapiens; identical to SEQ ID NO: 768056

SEQ ID NO: 768068 - protein, 310 aa, Homo sapiens; identical to SEQ ID NO: 768056

SEQ ID NO: 768069 - protein, 310 aa, Homo sapiens; identical to SEQ ID NO: 768056

SEQ ID NO: 768070 - protein, 105 aa, Homo sapiens [sequence omitted]

SEQ ID NO: 768071 - protein, 105 aa, Homo sapiens [sequence omitted]

SEQ ID NO: 768072 - protein, 310 aa, Homo sapiens; identical to SEQ ID NO: 768056

SEQ ID NO: 768073 - protein, 105 aa, Homo sapiens [sequence omitted]

SEQ ID NO: 768074 - protein, 137 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRERVKKTFFFFF

SEQ ID NO: 768075 - protein, 310 aa, Homo sapiens; identical to SEQ ID NO: 768056

SEQ ID NO: 768076 - protein, 310 aa, Homo sapiens; identical to SEQ ID NO: 768056

SEQ ID NO: 768077 - protein, 235 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHIHPRPGSPLAPVAPPWALGWNQEYFPKSDSLLLLAKLYLIQWVFPCTVDFPNVINFNIK

SEQ ID NO: 768078 - protein, 310 aa, Homo sapiens; identical to SEQ ID NO: 768056

SEQ ID NO: 768079 - protein, 105 aa, Homo sapiens [sequence omitted]

SEQ ID NO: 768080 - protein, 105 aa, Homo sapiens [sequence omitted]

SEQ ID NO: 768081 - protein, 310 aa, Homo sapiens; identical to SEQ ID NO: 768056

SEQ ID NO: 768082 - protein, 231 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPPCRLEEGPKEGEAVVLPEVEPGLTAREQEATPPTQGDHTAPDHSSGLNDHSHH

SEQ ID NO: 768083 - protein, 139 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQACA

SEQ ID NO: 768084 - protein, 162 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQAYPGPWAGIRNIFQRVIVFCFWQNST

SEQ ID NO: 768085 - protein, 221 aa, Homo sapiens
IFIFNVVYYKPLVYKNTNVYPWWGEAMGWAFVLSSMLCMPLHLLGCLLRAKGTMAECWKHLTQPIWGLHHLEYRAQDADVRGLTTLTPVSESSKVVVVESVMGQLSSHHQLTSGLWGKRLQYSILGVWAANLACSGFPPCALGWAHPREGTPDTAPTSRLKADALPAPPVFCVAALTHVCLSRPVPRRLSDPKKGFPDTRTEAGGLGLGEGGGPAGTFLLC

SEQ ID NO: 768086 - protein, 152 aa, Homo sapiens
IFIFNVVYYKPLVYKNTNVYPWWGEAMGWAFVLSSMLCMPLHLLGCLLRAKGTMAECWKHLTQPIWGLHHLEYRAQDADVRGLTTLTPVSESSKVVVVESVMGQLSSHHQLTSGSHSSPCFIPTPPLQGACLSLTLLGSAWERRGESTMSAH

SEQ ID NO: 768087 - protein, 358 aa, Homo sapiens
RRGAMAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 768088 - protein, 96 aa, Homo sapiens
MAEVLRTLAGKPKCHALRPMILFLIMLVLVLFGYGVLSPRSLMPGSLERGFCMAVREPDHLQRVSLPRMVYPQPKVLTPWTGLLQPRGARPAAPPA

SEQ ID NO: 768089 - protein, 77 aa, Homo sapiens
ETLSFGPFPSSRDYELTQPPSNHSDSSLGVWPWREGQCPVMVQRLCTPLLTCIPRFPCKLTWRRFVLAGWSTPSQRC

SEQ ID NO: 768090 - protein, 741 aa, Homo sapiens
MPSATMLDDGDTVVNETDTAPPSWSKNFVDEKDVSEAITKLYVLEQGSIGCYGGTRDGTQEDRGGRKLPRDREGGQPWLRERICRDLEGEGGAKAIDREQAFEPCLVKEPAFYPGPLMTYPWGDLNSFSCLWNPPLCLPHTPSPALVQELHSSGSGVLDERDASGGTVGVQQVWTDEEAPSHEWVLPDRGGWCMNVELRWVVGGMSVFEACPAPHLGSMNTLPTLTALFLESSPQLGIVGEDPLSAYRQALRESLYPPSVGSRALWGHAAGGGLPCCLALSSGPWSASLPCLLPRLLLLPSLPLCPLPAQFLSYLSACDRLLRQGYEEGLVDEAMEMFQFSESQVSRASCQGPRGWKGWGCTQEPGVQGHTSPQSQSVGPACGSVGRLPDFLSSEEEMAQGATAGTKVRGTEGDQEEVGRGQEAESSRGFALLDLINTASVTEWPLFVDTQIGAMGSTKMHDLSTWGACRLPQVHAAVGPIVTSCFLRLSLTLLPRLECNGTILAHCNLCPRGSSNSPASVSQVAGITGACHHTLLIFFVFSVETEFHHVDQAGLECLISSDPPASASQSAGITGVSHRTRPQYVTSKCPMAEQLFTEAEGDGGLGEASRRRERAEVGKFQALGSEGKESAGCAVIPPQCSGHGQGPWAVCAPGAGVRSAPLLPQQKVDSEWEEWEESQDRAHGQAGAFFPWQRKGGRNLHHPTGTEKWQVRPRIRLTWPGGSHSFLGLGAVGTGAGAPHG

SEQ ID NO: 768091 - protein, 198 aa, Homo sapiens
SPFALTSLTYQSLSLASSFSHYPPHLSHLSLSSAHTLLHPPRLSLLLTRAIPLSRSVPRTAHLSTLPLLASLFSPIFFSVTQYSPFPTSSRFSPFLVTPILHERHPLRPLLGSTLPHPIQLHLGIRKMLHGSELVSSLFPATPNSPSLSYFQSPTRTFLQEGKQFSDMGFQQDRIKEVLLVHGNRREQALEELVACAQ

SEQ ID NO: 768092 - protein, 152 aa, Homo sapiens
MMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 768093 - protein, 165 aa, Homo sapiens
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGTVSGQLSLQDALLLLLMGLGPLLRACGMPLTLLGLAFCLHPWA

SEQ ID NO: 768094 - protein, 277 aa, Homo sapiens
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGAPDMMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 768095 - protein, 250 aa, Homo sapiens
ALPRGSGEEAVAVSGPGPVGVLLPSWLTPTPGTLAPRSRTTSTMAAAWPPPPCTSEWVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 768096 - protein, 238 aa, Homo sapiens
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 768097 - protein, 238 aa, Homo sapiens; identical to SEQ ID NO: 768096

SEQ ID NO: 768098 - protein, 238 aa, Homo sapiens; identical to SEQ ID NO: 768096

SEQ ID NO: 768099 - protein, 139 aa, Homo sapiens
DPRWALYSLYVYKFLHFSYSSAKNPDGCFFQKVLNGFTKFFCKEQYCKLLKLYFYRLFALLWILCLSGFLKFFFYSEIMELVLAAAGALLFCGFIIYDTHSLMHKLSPEEYVLAAISLYLDIINLFLHLLRFLEAVNKK

SEQ ID NO: 768100 - protein, 82 aa, Homo sapiens
NYGSSVASATVHIRMGTLSPLQCLPAACLHCSASRSRLPASEGERPSPGTHRECSLSSRPSFSGYQRTGALLRESGRRFLPS

SEQ ID NO: 768101 - protein, 139 aa, Homo sapiens; identical to SEQ ID NO: 768099

SEQ ID NO: 768102 - protein, 285 aa, Homo sapiens
MADPDPRYPRSSIEDDFNYGSSVASATVHIRMVLQRDCTFSKQYMRIPSAPSATLNIIRFFHLRQSGRSGMVNIFYKGPTFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 768103 - protein, 238 aa, Homo sapiens; identical to SEQ ID NO: 768096

SEQ ID NO: 768104 - protein, 65 aa, Homo sapiens
LPLRTRLSRAGYTSPWRIFTGKPAGEGRSERRLRASSVLLAERGDGSGGRHSGNHLRPSPISIQR

SEQ ID NO: 768105 - protein, 652 aa, Homo sapiens
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIQNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 768106 - protein, 133 aa, Homo sapiens
KGRIHPLRVSPPCPTFWGQRSKASLGSPGLQGPVTPEPFEIQCLCPAPRSPTVKSTSAGPTLSCSSLSLMIMWLSPLSLPPPAGCRNDLSPGQRPQLWQGLLWSARPRLKAKQNQAGSLAGGKPDRTFVRLLL

SEQ ID NO: 768107 - protein, 124 aa, Homo sapiens
MLCCQGQLCTRIDQPHENAVSGLQALLPGITTCFCCPSQRKKNSCPNRRGFQLWFSGNVQQRQLPMETQPEALLGHIFSPLPQGERERKGRGPGAAPCKGPWKLAMCLSECPPTSFPYQAPRKH

SEQ ID NO: 768108 - protein, 1024 aa, Homo sapiens
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLWLLSGVKKLFIFQLIDGKVTVRNNIIVTHLTHSCLRSVLEQIAAYGQVVFRLQEFIDEVMGHSSESMLPGSGSVPKKSTEAPFRTYQAFMWALYKYFISFKEELAEIEKCIINNDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 768109 - protein, 611 aa, Homo sapiens
MSSGPLTCLTPCTRPFLNMTMLEKPLSKPDQGTLRADRAHSLPQVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 768110 - protein, 637 aa, Homo sapiens
MWDTTITLAIVVDKLAPRLSQLKVLHKVFSTGVAEVPPDTRNVVRASHLLNTLYKAILEYDNVGEASEQTVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHLESLALSLMAGMEQS

SEQ ID NO: 768111 - protein, 611 aa, Homo sapiens
MSSGPLTCLTPCTRPFLNMTMLEKPLSKPDQGTLRADRAHSLPQVSLLFSLWVETVRPYLQTVDEWIVHGHLWDGAREFIIQRNKNVPVNHRDFWYATYTLYSVSEKTENEEKMSDNASASSGSDQGPSSRQHTMVSFLKPVLKQIIMAGKSMQLLKNLQCAESTTCQAGARDAERKSLYTLFLESVQSRLRHGEDSTPQVLTEQQATKENLMKMQSIAESHLELDDVHDPLLAINFARMYLEQSDFHEKFAGGDVCVDRSSESVTCQTFELTLRSCLYPHIDKQYLDCCGNLMQTLKKDYRLVEYLQAMRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFLVTILNKAVCRGSFPHCEYIMLKYFYLCISL

SEQ ID NO: 768112 - protein, 276 aa, Homo sapiens
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDPLYVPDDRVLVTETQVIRETLW

SEQ ID NO: 768113 - protein, 66 aa, Homo sapiens
LQALLLAVGLVRGTFWPEDSAIEPLQYRCRCIHVHFHHVQLKSENIFIWFICKTCPQSAWHSRSCL

SEQ ID NO: 768114 - protein, 193 aa, Homo sapiens [sequence omitted]

SEQ ID NO: 768115 - protein, 148 aa, Homo sapiens
MIRVSYLGDDGIQRADSDTGELGVVLPESTESLKGDGGVRATSSSRSGLAAAASGPAAGLSRAASPAACAPAAGCAPPVTSMAGRGWISAKVVMVVGNWISLGIRCPLASGTWQRRNGPVYLRDLIGRMVANYTLSPIRRIRNRCFES

SEQ ID NO: 768116 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768117 - protein, 1095 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768118 - protein, 1095 aa, Homo sapiens; identical to SEQ ID NO: 768117

SEQ ID NO: 768119 - protein, 1132 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMVSLIQPSPLGLVPGPAPQEPQTGPSSTLSPSNPFSPEGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768120 - protein, 1018 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMVSLIQPSPLGLVPGPAPQEPQTGPSSTLSPSNPFSPRGVSLCAGWPLSP

SEQ ID NO: 768121 - protein, 69 aa, Homo sapiens
TESTLSPPAGGTPYCGMTCAELYEKLPQGYRMEQPRNCDDEVLSHPILELHDPISVMSDLSFDPCDPIT

SEQ ID NO: 768122 - protein, 571 aa, Homo sapiens
TQAEQSGPQHLTPGPARPGWPGSASGVWSGGCPLSCSPSSSWLLMGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768123 - protein, 350 aa, Homo sapiens
LTLAWTVSLLSHPVKGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768124 - protein, 334 aa, Homo sapiens
VTPTGLGSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768125 - protein, 159 aa, Homo sapiens
MYLISPRIARLSSFLGDTEGLCRNKYYWACLPCGALIATLMFLNYQCPITTQELKLLVLGVLLLWRYLSPGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 768126 - protein, 519 aa, Homo sapiens
MGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 768127 - protein, 519 aa, Homo sapiens; identical to SEQ ID NO: 768126

SEQ ID NO: 768128 - protein, 212 aa, Homo sapiens
MGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNPTVRCHTVLLPNTVRAHTCV

SEQ ID NO: 768129 - protein, 519 aa, Homo sapiens; identical to SEQ ID NO: 768126

SEQ ID NO: 768130 - protein, 409 aa, Homo sapiens
MGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQ

SEQ ID NO: 768131 - protein, 84 aa, Homo sapiens
EEMLVQVELAWKWHGEEGGTGSKPHASPICDTAFSLFLCPVDIPAHFSVTLAGEKWGADSLGVQCFPRATKEAEHASSPPAPLQ

SEQ ID NO: 768132 - protein, 183 aa, Homo sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 768133 - protein, 606 aa, Homo sapiens
KIFSVSPPAESVCGLGENVSDILGRSRGRAGSERPRDSPSLEPCPPRSPPVRRAPDIATLHPRDCPTPGPRGSAASLPPPTPAATAQFPQPDPVCRSQSLQAASGTFGGPVGRPGRAGTEPPRLGQWAWAGAVAEDLARPLQTPGDSHTAAAMATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 768134 - protein, 497 aa, Homo sapiens
KIFSVSPPAESVCGLGENVSDILGRSRGRAGSERPRDSPSLEPCPPRSPPVRRAPDIATLHPRDCPTPGPRGSAASLPPPTQQLRPSSLNLTQYVEASLCRRPAAVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 768135 - protein, 333 aa, Homo sapiens
MVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 768136 - protein, 290 aa, Homo sapiens
MASFMTLTSCSFCGSLSSDCSQRVHSWIPNSMRAEKAVATSSFTSVPVNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 768137 - protein, 79 aa, Homo sapiens
RPDYLSVGHDLRGSALSGAERAITLKMEIPGPMPPLIREMLENPEMFEDDSSQPGPHPNASSEDEVPGGQGKGGLKSPA

SEQ ID NO: 768138 - protein, 133 aa, Homo sapiens
LIHAKISLPCTPCHTCGTPQLSFRLSLCPYDLILDFWMPCLLLTSRDYPCQASDPPPLPSPCLLQVALTGDLTSSLSTHSLFSPSPRNSTNPPPPPTFQMLRICTRYTPEQDTMTFSDGLTLNRTQMHNAGFG

SEQ ID NO: 768139 - protein, 606 aa, Homo sapiens; identical to SEQ ID NO: 768133

SEQ ID NO: 768140 - protein, 443 aa, Homo sapiens
MYDCMETFAPGPRRLYGAAGPGAGLLRRATGGSCFAGLESFAWPQPASLQSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 768141 - protein, 606 aa, Homo sapiens; identical to SEQ ID NO: 768133

SEQ ID NO: 768142 - protein, 408 aa, Homo sapiens
MYDCMETFAPGPRRLYGAAGPGAGLLRRATGGSCFAGLESFAWPQPASLQSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEQQATVILHSTVKSKTFGSELAFPHFGNQFVTNLGEFFYFFILLLQRPFQGVHSQLLLPQLWWAACCWLLEPEQ

SEQ ID NO: 768143 - protein, 170 aa, Homo sapiens
MPTVEELYRNYGILADATEQVGQHKDAYQVILDGVKGGTKEKRLAAQFIPKFFKHFPELADSAINAQLDLCEDEDVSIRRQAIKELPQFATGENPSSSGQIILTQLLPEQMTLPEFNPSEQCPLLSIFKMDAKGTFRWVVQPKYFKERTLLENEQLNSFLQNLRLYQMKS

SEQ ID NO: 768144 - protein, 170 aa, Homo sapiens; identical to SEQ ID NO: 768143

SEQ ID NO: 768145 - protein, 170 aa, Homo sapiens; identical to SEQ ID NO: 768143

SEQ ID NO: 768146 - protein, 233 aa, Homo sapiens
MSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYEREEPSGEVEVAEVGAHEEIVVGEDSTE

SEQ ID NO: 768147 - protein, 88 aa, Homo sapiens
LTDIMMDPVHVVETGQHTAEGDTTSGSPPKKSSAGPKRDARQIYNPPSGKYSSNLGNFNYEREEPSGEVEVAEVGAHEEIVVGEDSTE

SEQ ID NO: 768148 - protein, 170 aa, Homo sapiens; identical to SEQ ID NO: 768143

SEQ ID NO: 768149 - protein, 170 aa, Homo sapiens; identical to SEQ ID NO: 768143

SEQ ID NO: 768150 - protein, 170 aa, Homo sapiens; identical to SEQ ID NO: 768143

SEQ ID NO: 768151 - protein, 217 aa, Homo sapiens
SPTVPQGEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYEREEPSGEVEVAEVGAHEEIVVGEDSTE

SEQ ID NO: 768152 - protein, 170 aa, Homo sapiens; identical to SEQ ID NO: 768143

SEQ ID NO: 768153 - protein, 170 aa, Homo sapiens; identical to SEQ ID NO: 768143

SEQ ID NO: 768154 - protein, 170 aa, Homo sapiens; identical to SEQ ID NO: 768143

SEQ ID NO: 768155 - protein, 277 aa, Homo sapiens
WSASPEHLTMLGITVLAALLACASSCGVPSFPPNLSARVVGGEDARPHSWPWQISLQYLKNDTWRHTCGGTLIASNFVLTAAHCISNTRTYRVAVGKNNLEVEDEEGSLFVGVDTIHVHKRWNALLLRNDIALIKLAEHVELSDTIQVACLPEKDSLLPKDYPCYVTGWGRLWTNGPIADKLQQGLQPVVDHATCSRIDWWGFRVKKTMVCAGGDGVISACNGDSGGPLNCQLENGSWEVFGIVSFGSRRGCNTRKKPVVYTRVSAYIDWINEKMQL

SEQ ID NO: 768156 - protein, 214 aa, Homo sapiens
MVSQSRAPNHVGHHCPRCALGLCNTRTYRVAVGKNNLEVEDEEGSLFVGVDTIHVHKRWNALLLRNDIALIKLAEHVELSDTIQVACLPEKDSLLPKDYPCYVTGWGRLWTNGPIADKLQQGLQPVVDHATCSRIDWWGFRVKKTMVCAGGDGVISACNGDSGGPLNCQLENGSWEVFGIVSFGSRRGCNTRKKPVVYTRVSAYIDWINEKMQL

SEQ ID NO: 768157 - protein, 277 aa, Homo sapiens; identical to SEQ ID NO: 768155

SEQ ID NO: 768158 - protein, 182 aa, Homo sapiens
WSASPEHLTMLGITVLAALLACASSCGVPSFPPNLSARVVGGEDARPHSWPWQISLQYLKNDTWRHTCGGTLIASNFVLTAAHCISNTRTYRVAVGKNNLEVEDEEGSLFVGVDTIHVHKRWNALLLRNDIALIKLAEHVELSDTIQVACLPEKDSLLPKDYPCYVTGWGRLWTPRPHFLKT

SEQ ID NO: 768159 - protein, 103 aa, Homo sapiens
SSLDHHLHSCMVLGHTMERMRNGYKIRRLRCIKIEENQSHLVTTQLRVRLALRGTLIESKSREACRAFALVTYTCPRTGLLETSALSRLLLDCFSGSCQPPNF

SEQ ID NO: 768160 - protein, 1277 aa, Homo sapiens
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESIQQHSLDAVLARSDSAQNVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQVTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGSDRPHPCTPRGALSMVAQGAGRPCSASTRATEERRGLWGRSGGPCWGRLGFWTPGISFSDVTMWRKAPGGQQCSCRWGLGNARPFPLLPAKTHIPASGSWGRFQSLENTQGLKLEVTPPMSGTCQLSPLVMRVLRGNRKQDCEWRSGREQGVAFGLHVPMWPDAGATFLLSAGDCSVPPPPHHGAPVSLGGTSFWPVHLSLAYKGAWPVPTPPCCASPWGPGEPALPRGCPGKSCPTASASSALTDPEPPGLLRCPVPTLLFKRTSDDVPEPQGFVSEGYKLFKN

SEQ ID NO: 768161 - protein, 142 aa, Homo sapiens
MTPPWATTHSCTRQEQTRMVYSLSLQGWCAGQASYTPQVCARPGTSQSLGGEVLGQCGMEEEGGKLSVGSSYWRGGDGHGTKSHPKRHPKSREGNTGYQKRRAPMDLLSKATHDCRTKTALYSPKTPVSALTPASNTKEADD

SEQ ID NO: 768162 - protein, 106 aa, Homo sapiens
MTPPWATTHSCTRQEQTRMVYSLSLQGWCAGQASYTPQVCARPGTSQSLGGEVLGQCGMEEEGGKLSVGSSYWRGGDGHGTKTQMGKCEKAEISKELRWRPTEEEC

SEQ ID NO: 768163 - protein, 106 aa, Homo sapiens; identical to SEQ ID NO: 768162

SEQ ID NO: 768164 - protein, 67 aa, Homo sapiens
CRYGLHHAPGPPATRVFAASQPGFPQVCPIPKATQLKLWLCFHSRDGQAGIGPPAAPGPRFSGWGAM

SEQ ID NO: 768165 - protein, 290 aa, Homo sapiens
AQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 768166 - protein, 123 aa, Homo sapiens [sequence omitted]

SEQ ID NO: 768167 - protein, 243 aa, Homo sapiens
RRSHPLLRAELAAAMTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYIQVAAQDLTDYGELSDWSLPATATMSLGK

SEQ ID NO: 768168 - protein, 167 aa, Homo sapiens
MKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 768169 - protein, 935 aa, Homo sapiens
VYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 768170 - protein, 737 aa, Homo sapiens
VYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIEPVQPYCFWEKMSICGKLFLCS

SEQ ID NO: 768171 - protein, 396 aa, Homo sapiens
CWLFFFFFFLFFLQMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIEPVQPYCFWEKMSICGKLFLCS

SEQ ID NO: 768172 - protein, 361 aa, Homo sapiens
MTLNTYMQEPTEYHIYQSLKINACKVRMNQYLKGLICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIEPVQPYCFWEKMSICGKLFLCS

SEQ ID NO: 768173 - protein, 226 aa, Homo sapiens [sequence omitted]

SEQ ID NO: 768174 - protein, 159 aa, Homo sapiens [sequence omitted]

SEQ ID NO: 768175 - protein, 935 aa, Homo sapiens; identical to SEQ ID NO: 768169

SEQ ID NO: 768176 - protein, 576 aa, Homo sapiens
VYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKYVDSF

SEQ ID NO: 768177 - protein, 172 aa, Homo sapiens
VYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKDANGYCELGNDWW

SEQ ID NO: 768178 - protein, 143 aa, Homo sapiens
QGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAP

SEQ ID NO: 768179 - protein, 145 aa, Homo sapiens
AVALPFGLCWLCGGSAVRRSFAERLCLAAVMSRHSRLQRQVLSLYRDLLRAGRGKPGAEARVRAEFRQHAGLPRSDVLRIEYLYRRGRRQLQLLRSGHATAMGAFVRPRAPTGEPGGVGSQPDDGDSPRNPHDSTGAPETRPDGR

SEQ ID NO: 768180 - protein, 398 aa, Homo sapiens
MEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 768181 - protein, 255 aa, Homo sapiens
MVLKTEEEDVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYETLAAEAVKMPERRTGT

SEQ ID NO: 768182 - protein, 511 aa, Homo sapiens
SSTHSERLLGLQLCASISALCASLPHRAQRVSTCRAGALSFCFLWTPSSLPLLCWRTHAVLAPALPAPTAVGAPGSLVLWGRCTEPPWPLTWRAVTCRGFDVAAQGWPGHWGRRRGDLTVVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 768183 - protein, 412 aa, Homo sapiens
MRAASRSAEPGSRTMEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 768184 - protein, 400 aa, Homo sapiens
MVLKTEEEDVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 768185 - protein, 390 aa, Homo sapiens
GGVAQRYCQCNNGVFQSTDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAIIMLNTSLHNPNVKDKPTVERFIAMNRGINDGGDLPEELLRNLYESIKNEPFKIPEDDGNDLTHTFFNPDREGWLLKLGGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 768186 - protein, 68 aa, Homo sapiens
LRAEGIFMRAASRSAEPGSRTMEEDDSYVPSDLTAEERQELENIRRRKQELLADIQFWQLSMFLEITA

SEQ ID NO: 768187 - protein, 113 aa, Homo sapiens
WDVSEHLSMQRLPFAFLSSLDTCYVLSFAIIMLNTSLHNPNVKDKPTVERFIAMNRGINDGGDLPEELLRVSKEEWSSFKSRKSSLGTGSSFVGRKKKHTIYQGSPLLICLTM

SEQ ID NO: 768188 - protein, 97 aa, Homo sapiens
LALVRWLMPCNPQHFWRPRWADHKVKSSRVEFHHVGQAGLELLTSDNLPTLASQIAGITGVSHCNKPSAILLLKYWRLLCISLLSSVLSVFCQYFHM

SEQ ID NO: 768189 - protein, 312 aa, Homo sapiens
TPRAAREPEEPSQDAPRDPAGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEPKHPEKEQQEGVPNSDEGYWDSTTPGPEEDSSSSGKKAGIPRDSYSGDALYDLYADPDGSPATLPGGKDNEETSSLSRLKPVSPGTITCPLRTPGSLLKDSKIPISIKHLTNLPSSHPVVHQQPSRSEMPRTKIPVSKVLVRRVSNRGLAGTTIRATACHDSAKKL

SEQ ID NO: 768190 - protein, 152 aa, Homo sapiens
SDPSADRICLMFSDVTSLKSFDSLTGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEP

SEQ ID NO: 768191 - protein, 159 aa, Homo sapiens [sequence omitted]

SEQ ID NO: 768192 - protein, 216 aa, Homo sapiens
KQWYQRRGPITAGIDVMKRSESWTLKKPKSVSKKLKSVFRVPDLSGMLQVLKELTDVQYYWVTIREYYKHLYGNKLENLEEMDKFLDTYTLPRLNQEEVESLNRPITGAEIVAIINSLPTKKSPGPEGFTAEFYQRYKEELVPFLLKLFQSIEKEGNLPNSFYEASIMLIPKPGRDTTKKTTTKQTQKTKPLWDDLGPLKKDFFNTTFVGRPRGPP

SEQ ID NO: 768193 - protein, 498 aa, Homo sapiens [sequence omitted]

SEQ ID NO: 768194 - protein, 498 aa, Homo sapiens [sequence omitted]

SEQ ID NO: 768195 - protein, 498 aa, Homo sapiens [sequence omitted]

SEQ ID NO: 768196 - protein, 498 aa, Homo sapiens [sequence omitted]

SEQ ID NO: 768197 - protein, 498 aa, Homo sapiens [sequence omitted]

SEQ ID NO: 768198 - protein, 179 aa, Homo sapiens [sequence omitted]

SEQ ID NO: 768199 - protein, 478 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKENQEAEKLEDDIRQERTAWKNYIQIERQKILKGFNEMRVILDNEEQRELQKLEEGCQHAHLRSPAEVDGIVSRDAAGYQFLLSLRSESWTLKKPKSVSKKLKSVFRVPDLSGMLQVLKELTDVQYYWVDVMLNPGSATSNVAISVDQRQVKTVRTCTFKNSNPCDFSAFGVFGCQYFSSGKYYWEVDVSGKIAWILGVHSKISSLNKRKSSGFAFDPSVNYSKVYSRYRPQYGYWVIGLQNTCEYNAFEDSSSSDPKVLTLFMAVPPCRIGVFLDYEAGIVSFFNVTNHGALIYKFSGCRFSRPAYPYFNPWNCLVPMTVCPPSS

SEQ ID NO: 768200 - protein, 195 aa, Homo sapiens [sequence omitted]

SEQ ID NO: 768201 - protein, 498 aa, Homo sapiens [sequence omitted]

SEQ ID NO: 768202 - protein, 359 aa, Homo sapiens
MDFSVKVDIEKEVTCPICLELLTEPLSLDCGHSFCQACITAKIKESVIISRGESSCPVCQTRFQPGNLRPNRHLANIVERVKEVKMSPQEGQKRDVCEHHGKKLQIFCKEDGKVICWVCELSQEHQGHQTFRINEVVKECQEKLQVALQRLIKENQEAEKLEDDIRQERTAWKNYIQIERQKILKGFNEMRVILDNEEQRELQKLEEGEVNVLDNLAAATDQLVQQRQDASTLISDLQRRLTGSSVEMLQDVIDVMKRSEKLDSEKVEEYNLRYSYMKSWAGLLRILGVVELLLGAGVFACVTAYIHKDSEWYNLFGYSQPYGMGGVGGLGSMYGGYYYTAEDPLCTRVAGSRSRIADK

SEQ ID NO: 768203 - protein, 325 aa, Homo sapiens
KKKRLALDSEAAVSADKPDSVLTHHVPSFLQKLCKERAQKLCRNSTRVPAQCTVPSHPQSTPVHSPDRMLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCVTPPSESKSKSPPPERKNRGERGPSSPPTTTAPMRVSKRKSFQLRGSTEKLIVSKESLFTLPELGDEAFDCDWDEEMRKKS

SEQ ID NO: 768204 - protein, 325 aa, Homo sapiens; identical to SEQ ID NO: 768203

SEQ ID NO: 768205 - protein, 104 aa, Homo sapiens
MEEDPSQPSQSPSSKCLSSSICSQIPWHSRQACPWEGPWDGEAGFAALHACPLGFQLTHPRVSGALQDGKCWGGGRQTTLCPTGTDPPCHRLPKGGPQNPLPSP

SEQ ID NO: 768206 - protein, 120 aa, Homo sapiens
MASVGEEGGRPLCAPRALTHPAIGFLREPPETQSTISTSSDTRVEQVEEEQESHEQQNARNRKDTGTEKREKREKEKDSSKRRETAQREGEGEEENEQTQKNDKERKSRGDRQQRQKKGE

SEQ ID NO: 768207 - protein, 607 aa, Homo sapiens
MEEDPSQPSQSPSSKCLSSSICSQIPWHSRQACPWEGPWDGEAGFAALHACPLGFQLTHPRVSGALQDGKCWGGGRQTTLCPTGTDPPCHRLPKGAPGSLPSLYHVDACVSGNDPMRRLTINWRHGKTTGDKSKEWDTKGKNKGHIQKDKKGTQAPKGQARQERTTGSAKKDHWTAHCTEPPRDCRGLNHHIVTTSTRRGKRGGHKEKTHKTQPSREAQHHARARLRPPTRPTDQRGQRTRASDDTGTNKAETGKNNTQAQRRHTQPAPHQKRNKEEQEAHTNTTRWNNRTTGKHHRAGRHKTKETSQRQHDHKTSGDNPNTQGQNKADKEARQKQQHTEVANQAHLEQTQGTPPPRHHHGATTNKRRQREKHRTAARPQQPQHATNKQHKNTQPERTRQTETRHEKRPEQQKTTQTSKQNEIRANRPTTKASKTPLHEGHNTTQQERTQEQQWRHKKRTRATHDNRQPRARESASSRQTHGETHNQHHNYKAGRHNRGRRTHRHTRNTQTHDDDRKSTTERKEKGDPTHTAPTLDNDHREHQQISAPRHKTNQSKNRQPRRTETHQTESTTRHNADDPKQARDASNRRTTEAHHRHNATDTGTAYG

SEQ ID NO: 768208 - protein, 187 aa, Homo sapiens
MEEDPSQPSQSPSSKCLSSSICSQIPWHSRQACPWEGPWDGEAGFAALHACPLGFQLTHPRVSGALQDGKCWGGGRQTTLCPTGTDPPCHRLPKGAPRNTIDNQHSSDTRVEQVEEEQESHEQQNARNRKDTGTEKREKREKEKDSSKRRETAQREGEGEEENEQTQKNDKERKSRGDRQQRQKKGE

SEQ ID NO: 768209 - protein, 498 aa, Homo sapiens
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 768210 - protein, 139 aa, Homo sapiens
SADEILWLNTLLILGIRHRACLSPNSRLQFPASSRTNYSDKPVTPSRGNQAHSALLLLQSLPPAAPPCYRVPECSLHIALHSVQGPSPLDWSICDQSAAVDCIRPASSVVCSAIPVSLGVGTGAGAGAWGEGIPLSSME

SEQ ID NO: 768211 - protein, 199 aa, Homo sapiens
MHIEYGLRRRNLSKTFRRSIRILPSTSIGGYDYQVEPPLPSHHHPPRPRGGVELRRTSEKIDRITCPRGRDTTPRRGLPTAGVERATTPSTTPPHDSSSGLRLSRSCRVPDRIPRYQLWWAPTLAPRQGYAAHPPRAEDDTQVAHLESPVRISSDDWMVPMPTERGGYRRMRAAFHAAPYQNLDCAEGRRISVDKVTQI

SEQ ID NO: 768212 - protein, 152 aa, Homo sapiens
APDGAGGGETRHPPAQSCLTRPGRTPPPGCLGTIPGIQGKAVRAGTGGYVRHRLFPITIATEDWSRCGSRSVLLQMVGYQESCSGNLTTQWKKHWSSWLSLQTPGGTPLGSSSSHPFGLRLNYTTNFPGSPPCRWQIVELLGLHSCMKQFSY

SEQ ID NO: 768213 - protein, 69 aa, Homo sapiens
THAYDETRGIRTTTSDRVTFIDLHMLNQPCILGTKPTPLLRMNFLMCCWICFASILLRIFAQCLPKTLA

SEQ ID NO: 768214 - protein, 197 aa, Homo sapiens
MSMEYFSICFVSTLISLSSCLWFSLKRSFTFFLSCIPRYFFLFVANVNESSFMICLPACLLFVHGNASYFCTLILYPEILLLLLITLRSFGPETMRFSRCRIRSSANKDNLTSSLSIRILFISSSGLIFLAKASDTILNGSGERGHSFLVPVFRWNVSSFCTFSMILAVGLLYMALIIFRYVSSLPSLLRILNLKEC

SEQ ID NO: 768215 - protein, 475 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768216 - protein, 475 aa, Homo sapiens; identical to SEQ ID NO: 768215

SEQ ID NO: 768217 - protein, 475 aa, Homo sapiens; identical to SEQ ID NO: 768215

SEQ ID NO: 768218 - protein, 475 aa, Homo sapiens; identical to SEQ ID NO: 768215

SEQ ID NO: 768219 - protein, 475 aa, Homo sapiens; identical to SEQ ID NO: 768215

SEQ ID NO: 768220 - protein, 475 aa, Homo sapiens; identical to SEQ ID NO: 768215

SEQ ID NO: 768221 - protein, 475 aa, Homo sapiens; identical to SEQ ID NO: 768215

SEQ ID NO: 768222 - protein, 475 aa, Homo sapiens; identical to SEQ ID NO: 768215

SEQ ID NO: 768223 - protein, 520 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQKRTRRQGVCQRQSWGLTPGRWAPEPTLLSSPWAKHRLTPSPSPPKGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768224 - protein, 475 aa, Homo sapiens; identical to SEQ ID NO: 768215

SEQ ID NO: 768225 - protein, 471 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKEFRVSSTAVLPAQTDFL

SEQ ID NO: 768226 - protein, 443 aa, Homo sapiens
MAAKSQPNIPKAKSLDGVTNDRTASQGQWGRACCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768227 - protein, 487 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVSSPCPGVGTQQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768228 - protein, 475 aa, Homo sapiens; identical to SEQ ID NO: 768215

SEQ ID NO: 768229 - protein, 440 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768230 - protein, 323 aa, Homo sapiens
LGRRPGVDIGRELSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768231 - protein, 255 aa, Homo sapiens
MGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 768232 - protein, 475 aa, Homo sapiens; identical to SEQ ID NO: 768215

SEQ ID NO: 768233 - protein, 310 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQVPVMAGEGETPMPAGSGGTRKPERIPMTLIYCL

SEQ ID NO: 768234 - protein, 55 aa, Homo sapiens
MAAKSQPNIPKAKSLDGVTYADDYVFGTGTVSARWMRVASRGWIDDVRQALSQSL

SEQ ID NO: 768235 - protein, 152 aa, Homo sapiens [sequence omitted]

SEQ ID NO: 768236 - protein, 244 aa, Homo sapiens
ADADADADAKVAAEVAAEVAAAAAAADADADETLGDCEGNPDFQMASLYVGDLHPEVTEAMLYEKFSPAGPILSIRICRDKITRRSLGYAYVNYQQPVDAKRALETLNFDVIKGRPVRIMWSQRDPSLRKSGVGNVFIKNLGKTIDNKALYNIFSAFGNILSCKVACDEKGPKGYGFVHFQKQESAERAIDVMNGMFLNYRKIFVGRFKSHKEREAERGAWARQSTSADVKDFEEDTDEEATLR

SEQ ID NO: 768237 - protein, 35 aa, Homo sapiens
MPHGCPLSLLLGELKLHGRSPRGAPSNKLDEEEKS

SEQ ID NO: 768238 - protein, 107 aa, Homo sapiens
GPASGLHGHLGLARPMHDLTAAQGYGRALVHGAQVEGAGAQLGWDSAHLPWWDRYSVPGSLGHRHSLLLMVSARARSVRSEGMWGLVRKRATAHYENFPFSAGIVTV

SEQ ID NO: 768239 - protein, 132 aa, Homo sapiens
CSQKGESISFPAFQARIQRFTPVGQLKWQLTLESIPIQGQVFSKAAITMTYWDSKLLPKNAHSLVTSSKDQTVEAYHWHHEAYGYFLPIQTRWQDNDQYGHVNNAVYYSYFDTIISLYLIRSLKFCSSSPSL

SEQ ID NO: 768240 - protein, 74 aa, Homo sapiens
ANRWETPLTFLMILVPSTFLVAMVHAVFWACLGNLIHWWIFQSQLMSIPVYPPPSTSLFFPLSSARTTRHFDFA

SEQ ID NO: 768241 - protein, 123 aa, Homo sapiens
LQWGHWRKNRLAGRKCHCNPSTLVRGRWIVRSGVDQPGQHSETPSLLKIQKLAGCSGACLQSQLLGKLRQENHLNPGGGGCGELRSCHCTPTWAIEQDCLKRKKKTKECSVCTLLPLPMVWEW

SEQ ID NO: 768242 - protein, 377 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 768243 - protein, 360 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 768244 - protein, 342 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 768245 - protein, 312 aa, Homo sapiens
MSGTNQSSVSEFLLLGLSRQPQQQHLLFVFFLSMYLATVLGNLLIILSVSIDSCLHTPMYFFLSNLSFVDICFSFTTVPKMLANHILETQTISFCGCLTQMYFVFMFVDMDNFLLAVMAYDHFVAVCHPLHYTAKMTHQLCALLVAGLWVVANLNVLLHTLLMAPLSFCADNAITHFFCDVTPLLKLSCSDTHLNEVIILSEGALVMITPFLCILASYMHITCTVLKVPSTKGRWKAFSTCGSHLAVVLLFYSTIIAVYFNPLSSHSAEKDTMATVLYTVVTPMLNPFIYSLRNRYLKGALKKVVGRVVFSV

SEQ ID NO: 768246 - protein, 1187 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768247 - protein, 73 aa, Homo sapiens
MAGLFEASKLITRFPKGTGLAGVCVPALKVYHLMKNCWETEASFRPTFENLIPILKTVHEKYQGQAPSVFSVC

SEQ ID NO: 768248 - protein, 1319 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGGRDPASPRDLRGRGYSVGVALWAGPVWPSQLETLNPRLQYAVLGIWVSVAGLPPSHLGGATCWGQDGREPPAAPSSENGVLDGSIPPEKLGLVCAGLGLPSRPWRGSAGLKVGGPRPALYRPPPGPPLSAAGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768249 - protein, 1224 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPESSSKLLVRLGVVAHTYPSTLGGRGGRIAYTQEFKTSLDIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768250 - protein, 1088 aa, Homo sapiens
MLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768251 - protein, 1158 aa, Homo sapiens
MYPALWPETSSAIGSILAAREAGKCSPPVRPQHGQHTHCPLPRGNVRLKLQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768252 - protein, 984 aa, Homo sapiens [sequence omitted]

SEQ ID NO: 768253 - protein, 897 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHHLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768254 - protein, 1187 aa, Homo sapiens; identical to SEQ ID NO: 768246

SEQ ID NO: 768255 - protein, 1187 aa, Homo sapiens; identical to SEQ ID NO: 768246

SEQ ID NO: 768256 - protein, 1175 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVRLPLSFPDPTILLWRGQPPPALVFPSRSIIS

SEQ ID NO: 768257 - protein, 210 aa, Homo sapiens
MEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768258 - protein, 1118 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTVRARPAAPPGVC

SEQ ID NO: 768259 - protein, 996 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSWQ

SEQ ID NO: 768260 - protein, 1187 aa, Homo sapiens; identical to SEQ ID NO: 768246

SEQ ID NO: 768261 - protein, 984 aa, Homo sapiens [sequence omitted]

SEQ ID NO: 768262 - protein, 404 aa, Homo sapiens
MELIRAGTWRSTLGLDSASWGTGWGRGEDVDSSGSLSQQKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTKFLELIGIAQGQMTVLRLTELLERGERLPRPDKCPCEVYHLMKNCWETEASFRPTFENLIPILKTVHEKYQGQAPSVFSVC

SEQ ID NO: 768263 - protein, 1150 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEICFDGEAPLQSRSPSEKEHFYQRQHRLPEPSCPQLATLTSQCLTYEPTQRPSFRTILRDLTRLQPHNLADVLTVNPDSPASDPTVFHKRYLKKIRDLGEGHFGKVSLYCYDPTNDGTGEMVAVKALKADCGPQHRSGWKQEIDILRTLYHEHIIKYKGCCEDQGEKSLQLVMEYVPLGSLRDYLPRHSIGLAQLLLFAQQICEGMAYLHAQHYIHRDLAARNVLLDNDRLVKIGDFGLAKAVPEGHEYYRVREDGDSPVFWYAPECLKEYKFYYASDVWSFGVTLYELLTHCDSSQSPPTVYHLMKNCWETEASFRPTFENLIPILKTVHEKYQGQAPSVFSVC

SEQ ID NO: 768264 - protein, 984 aa, Homo sapiens [sequence omitted]

SEQ ID NO: 768265 - protein, 876 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMVMVKYLATLERLAPRFGTERVPVCHLRLLAQAEGEPCYIRDSGVAPTDPGPESAAGPPTHEVLVTGTGGIQWWPVEEEVNKEEGSSGSSGRNPQASLFGKKAKAHKAVGQPADRPREPLWAYFCDFRDITHVVLKEHCVSIHRQDNKCLELSLPSRAAALSFVSLVDGYFRLTADSSHYLCHEVAPPRLVMSIRDGIHGPLLEPFVQAKLRPEDGLYLIHWSTSHPYRLILTVAQRSQAPDGMQSLRLRKFPIEQQDGAFVLEGWGRSFPSVRELGAALQGCLLRAGDDCFSLRRCCLPQPGETSNLIIMRGARASPRTLNLSQLSFHRVDQKEITQLSHLGQGTRTNVYEGRLRVEGSGDPEEGKMDDEDPLVPGRDRGQELRVVLKVLDPSHHDIALAFYETASLMSQVSHTHLAFVHGVCVRGPENIMVTEYVEHGPLDVWLRRERGHVPMAWKMVVAQQLASALSYLENKNLVHGNVCGRNILLARLGLAEGTSPFIKLSDPGVGLGALSREERVERIPWLAPECLPGGANSLSTAMDKWGFGATLLEIAEGASCSLLQDETKRGMSASPTPCALLLSRDPTSVNLFFFLGREPNHDLEGPNICRGTNPALKSPSFQT

SEQ ID NO: 768266 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 768267 - protein, 193 aa, Homo sapiens
HLAKCHTPHSTMSQCKKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 768268 - protein, 188 aa, Homo sapiens
LRYSKDLPPTRREQAIMALQAAPVMSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 768269 - protein, 158 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERTCERG

SEQ ID NO: 768270 - protein, 205 aa, Homo sapiens
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 768271 - protein, 205 aa, Homo sapiens; identical to SEQ ID NO: 768270

SEQ ID NO: 768272 - protein, 175 aa, Homo sapiens
MPPGTRACRVPRPGRRAPRPRRDGEPGGHGVAPASAEEVGARPGLRAVARLLPQQHLQAGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 768273 - protein, 94 aa, Homo sapiens
ARAPPLTNMLKFRAAGPAPAWRDGAAGRVGAMPPGTRACRVPRPGRRAPRPRRDGEPGGHGVAPASAEEVGARPGLRAVARLLPQQHLQAERAA

SEQ ID NO: 768274 - protein, 135 aa, Homo sapiens
MVNLAAMVWRRLLRKRWVLALVFGLSLVYFLSSTFKQSENSQLLPKSCTEKPAHFHLDIELPSWKQSPLHPSHSTSKDWNTDLFPPPRFWAFGWPQVFDNPPLGPEVLKDAKRDIEFTHTHTQGAKKPLGYWPNQ

SEQ ID NO: 768275 - protein, 205 aa, Homo sapiens; identical to SEQ ID NO: 768270

SEQ ID NO: 768276 - protein, 205 aa, Homo sapiens; identical to SEQ ID NO: 768270

SEQ ID NO: 768277 - protein, 205 aa, Homo sapiens; identical to SEQ ID NO: 768270

SEQ ID NO: 768278 - protein, 70 aa, Homo sapiens
NLLQVHDHNQPIPWKVQFNLGNSSRPSNQCRNSIQGKHLITDELGEAGFPSSPGGQERRLVGPFIGFLFE

SEQ ID NO: 768279 - protein, 845 aa, Homo sapiens
MEPSPEPPSLESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 768280 - protein, 102 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQVSAPGPRGGSAASCFEGC

SEQ ID NO: 768281 - protein, 830 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNS

SEQ ID NO: 768282 - protein, 876 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 768283 - protein, 876 aa, Homo sapiens; identical to SEQ ID NO: 768282

SEQ ID NO: 768284 - protein, 939 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 768285 - protein, 856 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 768286 - protein, 876 aa, Homo sapiens; identical to SEQ ID NO: 768282

SEQ ID NO: 768287 - protein, 898 aa, Homo sapiens
GRSPRGRSERPPTDGTGSLAVGRAGGNAARPAALGLSGPSKPSSAIGAGDSRAQRPARPPAGLPPASPDPRLRRPAAPQPALRQESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKDLWLSCALHRRVQHGPWCPPEAAGKVLERACHPTPLRPSEGLLCM

SEQ ID NO: 768288 - protein, 366 aa, Homo sapiens
LLRWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQG

SEQ ID NO: 768289 - protein, 195 aa, Homo sapiens
LLRWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCASKYVRALGMGR

SEQ ID NO: 768290 - protein, 112 aa, Homo sapiens
APAATEHGSEPREIPGCGRPTLCPWWLVRAAGLGLLMLLSWGQTPWAGSRRGQTELGQGAFGPRAVGQALEWQPVITVISLNGQCSFPGLVPWRPRGSGEKRGAPGLRFSAY

SEQ ID NO: 768291 - protein, 143 aa, Homo sapiens
LASDVIHAQSRDLPRIFRVTTSQLAVPPTTCTVLLLAESEGERERWLQVLGELQRLLLDARPRPRPVYTLKEAYDNGLPLLPHTLCAAILAQDDGPHPNPSGKACPDWERRVSEAGTAGLLPPPFPQDKQAQQGRWTAQSPCH

SEQ ID NO: 768292 - protein, 271 aa, Homo sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFSQSICLTRHQRSHSGDKPFKCNECGKAFNQSACLMQHQRIHSGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 768293 - protein, 271 aa, Homo sapiens; identical to SEQ ID NO: 768292

SEQ ID NO: 768294 - protein, 271 aa, Homo sapiens; identical to SEQ ID NO: 768292

SEQ ID NO: 768295 - protein, 49 aa, Homo sapiens
MQSSSVLTELETGVYQISAVHTSCSYAEKLGVEKQLMGAGDILSWCLER

SEQ ID NO: 768296 - protein, 1950 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768297 - protein, 1939 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768298 - protein, 2118 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRVRGQRWTGLLSREGQAPKLLSPQPPCSSDTCARAETPAQPVLSPLKPMSCPLPQCASCPIHLCHLLGGPNCLCSPEDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVGEGVESPWGPEPLLGLGWPRTNSAGTTHHSGWGGCWEAGRSWLWNIFLGQPLIWGGGPCSWSLERLSKAAPGWRGWCPCGGGDGLHYGKGIFQPCTQFCLALAEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768299 - protein, 1948 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVEPGLGSPGSSEERPPS

SEQ ID NO: 768300 - protein, 1054 aa, Homo sapiens
LCQSYGAWEGEDHLTVGQGEGLPGKLEGPLMQLGTPFSLPCAYSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768301 - protein, 2180 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQVGHPWVPPHSPLAPYHTLGTARAGARGRLFPSLLGPSSTCLSSFQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768302 - protein, 585 aa, Homo sapiens
MTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768303 - protein, 585 aa, Homo sapiens; identical to SEQ ID NO: 768302

SEQ ID NO: 768304 - protein, 1947 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEVTTSHKERRRSLNSFCPSAFPFPFERKDSGVFTVT

SEQ ID NO: 768305 - protein, 507 aa, Homo sapiens
VAAVSQIQRIPLACTGLHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768306 - protein, 1659 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQQALPGDHACSGPSSSPGSLGRVGPHPAPTNCIHSQWHVSAPGKGPHLRPLPGGYQLSVP

SEQ ID NO: 768307 - protein, 1590 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTILGLRVERLS

SEQ ID NO: 768308 - protein, 1484 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTP

SEQ ID NO: 768309 - protein, 68 aa, Homo sapiens
LTRGSLPKWNYSGDLGARVALHELYKYINKYYDQIITALEEDGTAQKMQLGYRLQQIAAAVENKVTDL

SEQ ID NO: 768310 - protein, 1365 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTVIPLTGTISMMSLFPYQLPFRACCAF

SEQ ID NO: 768311 - protein, 615 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVNDQIGRALVGRALGIKVWVEILDPDVGHARYHMASHKSLLLGAQFPHLFLTQARGCLGRPEGC

SEQ ID NO: 768312 - protein, 614 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGAGGLRTSVERYR

SEQ ID NO: 768313 - protein, 112 aa, Homo sapiens
MPSERHLTLCLSSRSVGRSLAGLGIDLGQTLAHRWLLTQVQMGNLRFSLGHVQYDGESPGAFPVAAQVGLGVGTSLLALGVIIIVLMYRWVQPDVAGLGQVVGSGWTGKGQT

SEQ ID NO: 768314 - protein, 92 aa, Homo sapiens
MLFRGIKHQVDKGPVDSVTGKAKYTLNDNRLLREDVEYRPLVRVCKCVACSLSAVRARVESVWVCGVWTPASDVVPGCRAGLTSGWLLERAH

SEQ ID NO: 768315 - protein, 2135 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768316 - protein, 2135 aa, Homo sapiens; identical to SEQ ID NO: 768315

SEQ ID NO: 768317 - protein, 2042 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVGEGVESPWGPEPLLGLGWPRTNSAGTTHHSGWGGCWEAGRSWLWNIFLGQPLIWGGGPCSWSLERLSKAAPGWRGWCPCGGGDGLHYGKGIFQPCTQFCLALAEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768318 - protein, 1688 aa, Homo sapiens
MIDRAAYLHALFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768319 - protein, 843 aa, Homo sapiens
MLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768320 - protein, 585 aa, Homo sapiens; identical to SEQ ID NO: 768302

SEQ ID NO: 768321 - protein, 631 aa, Homo sapiens
PLLELTLAELPLPELPLELPLEIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 768322 - protein, 1915 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQVMETQQSLRALPPPSSSLSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMPGVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWVRPPSASWVGHRPPATTVLPPSHCPFAGKPLGTSA

SEQ ID NO: 768323 - protein, 264 aa, Homo sapiens [sequence omitted]

SEQ ID NO: 768324 - protein, 147 aa, Homo sapiens
PQTLLKQVDLGCLPTKEAPLLYPVLSPSGTPGLGSLGHGGDSASHCSAHPILYLSGPLLPQPFPGVLGCLLWLSAPLVSLTFHLASSLNYSGDLGARVALHELYKYINKYYDQIITALEEDGTAQKMQLGYRLQQIAAAVENKVTDL

SEQ ID NO: 768325 - protein, 1344 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFREPCHATPPSSPRHPCWYRAQ

SEQ ID NO: 768326 - protein, 693 aa, Homo sapiens [sequence omitted]

SEQ ID NO: 768327 - protein, 84 aa, Homo sapiens
MPALGPALLQALWAGWVLTLQPLPPTAFTPNGTYLQHLARDPTSGTLYLGATNFLFQLSPGLQLEATVSTGPVLDSRDCLPPVM

SEQ ID NO: 768328 - protein, 360 aa, Homo sapiens [sequence omitted]

SEQ ID NO: 768329 - protein, 119 aa, Homo sapiens
MSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGRKTFKIFF

SEQ ID NO: 768330 - protein, 210 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGLVRWNP

SEQ ID NO: 768331 - protein, 210 aa, Homo sapiens; identical to SEQ ID NO: 768330

SEQ ID NO: 768332 - protein, 191 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGLVRWNP

SEQ ID NO: 768333 - protein, 179 aa, Homo sapiens
MSEEQFGGDGAAAAATAAVGGSAGEQEGAMVSEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGLVRWNP

SEQ ID NO: 768334 - protein, 112 aa, Homo sapiens
MFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGLVRWNP

SEQ ID NO: 768335 - protein, 191 aa, Homo sapiens; identical to SEQ ID NO: 768332

SEQ ID NO: 768336 - protein, 210 aa, Homo sapiens; identical to SEQ ID NO: 768330

SEQ ID NO: 768337 - protein, 210 aa, Homo sapiens; identical to SEQ ID NO: 768330

SEQ ID NO: 768338 - protein, 181 aa, Homo sapiens
MVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGLVRWNP

SEQ ID NO: 768339 - protein, 198 aa, Homo sapiens
MTTVYTSQVRQNYHQDSEAAINRQIKPGALRTSYVNLFHGLTTFGPAMHVASNELWPILPSPNLMRSREHAENPDEGCRTNEVAESPFGVLRTRPVTDWESRLNAWRGAYTWDHCEPAPTELHQMALAKVTPHRGVYVEAPYSFLLSVKASKRLGAQLHHVATRSRPRNGLRDIFCENTLLHVIYDTNRILPQSGSNR

SEQ ID NO: 768340 - protein, 77 aa, Homo sapiens
MEYHPDLENLDEDGYTQLHFDSQSNTRIAVVSEKGSCAASPPWRLIAVILGILCLVILVIAVVLGTMAGFKAVEFKG

SEQ ID NO: 768341 - protein, 132 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELVSVDFCYDYLWCVS

SEQ ID NO: 768342 - protein, 247 aa, Homo sapiens
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 768343 - protein, 116 aa, Homo sapiens
MEYHPDLENLDEDGYTQLHFDSQSNTRIAVVSEKGSCAASPPWRLIAVILGILCLVILVIAVVLGTMGTGQFLKDLSFLNNRRKLFGDPIQEATHWRMATFYQEIKRTTVNPHNHL

SEQ ID NO: 768344 - protein, 189 aa, Homo sapiens
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELISDQNHSYPRKPISKLCMDSRVSHL

SEQ ID NO: 768345 - protein, 168 aa, Homo sapiens
MEYHPDLENLDEDGYTQLHFDSQSNTRIAVVSEKGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 768346 - protein, 146 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELSLTLLPKLECSEAATSQAQVILPPQLPE

SEQ ID NO: 768347 - protein, 168 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNFLTSFLLAAQA

SEQ ID NO: 768348 - protein, 201 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 768349 - protein, 247 aa, Homo sapiens; identical to SEQ ID NO: 768342

SEQ ID NO: 768350 - protein, 143 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELISDQNHSYPRKPISKLCMDSRVSHL

SEQ ID NO: 768351 - protein, 192 aa, Homo sapiens
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELSLTLLPKLECSEAATSQAQVILPPQLPE

SEQ ID NO: 768352 - protein, 123 aa, Homo sapiens
MEYHPDLENLDEDGYTQLHFDSQSNTRIAVVSEKGSCAASPPWRLIAVILGILCLVILVIAVVLGTMGEYLVEEINNRQFSKQLLCARHSFKGLTCIIYFNLYIIWFYLYWVGAVNAHFTYKG

SEQ ID NO: 768353 - protein, 45 aa, Homo sapiens
MEYHPDLENLDEDGYTQLHFDSQSNTRIAVVSEKGIYSKTSVFPT

SEQ ID NO: 768354 - protein, 255 aa, Homo sapiens
MGITALNYGEMFKTPSKGVTDSIVEDWDWAPLEVDGKISSYGKEPITAQLERSQASCETVWNLIAMILLLTSGSDIFCSRNFKQIRDKKKINLLKNIDEKLTEAARELGYSLEQRTVKMKQRDKKVVTKTFHGAGLVVPVDKNDVGYRELPETDADLKRICKTIVEAASDEERLKAFAPIQEMMTFVQFANDECDYGMGLELGMDLFCYGSHYFHKVAGQLLPLAYNLLKRNLFAEIIEEHLANRSQENIDQLAA

SEQ ID NO: 768355 - protein, 314 aa, Homo sapiens
FYYDPPEFQENHYKLSLPEDFYHFWKFCEELDPEKPSDSLSASLGLQLVGPYDILAGKHKTKKKSTGLNFNLHWRFYYDPPEFQTIIIGDNKTQYHMGYFRDSPDEFPVYVGINEAKKNCIIVPNGDNVFAAVKLFLTKKLKEITDKKKINLLKNIDEKLTEAARELGYSLEQRTVKMKQRDKKVVTKTFHGAGLVVPVDKNDVGYRELPETDADLKRICKTIVEAASDEERLKAFAPIQEMMTFVQFANDECDYGMGLELGMDLFCYGSHYFHKVAGQLLPLAYNLLKRNLFAEIIEEHLANRSQENIDQLAA

SEQ ID NO: 768356 - protein, 346 aa, Homo sapiens
MVGGGGKRRPGGEGPQCEKTTDVKKSKFCEADVSSDLRKEVENHYKLSLPEDFYHFWKFCEELDPEKPSDSLSASLGLQLVGPYDILAGKHKTKKKSTGLNFNLHWRFYYDPPEFQTIIIGDNKTQYHMGYFRDSPDEFPVYVGINEAKKNCIIVPNGDNVFAAVKLFLTKKLKEITDKKKINLLKNIDEKLTEAARELGYSLEQRTVKMKQRDKKVVTKTFHGAGLVVPVDKNDVGYRELPETDADLKRICKTIVEAASDEERLKAFAPIQEMMTFVQFANDECDYGMGLELGMDLFCYGSHYFHKVAGQLLPLAYNLLKRNLFAEIIEEHLANRSQENIDQLAA

SEQ ID NO: 768357 - protein, 346 aa, Homo sapiens; identical to SEQ ID NO: 768356

SEQ ID NO: 768358 - protein, 160 aa, Homo sapiens
MNGPAGLAGGCKNMLSPKIRQARRARSKSLVMGEQSRSPGRMPCPHRLGPVLKAGWLKKQRSIMKNWQQRWFVLRGDQLFYYKDKDEIKPQGFISLQGTQVTDFLLGPEDPGKHLFEISPGGAGEREKVPANPEALLLMASSQRDMEDWVQAIRRVIWAP

SEQ ID NO: 768359 - protein, 504 aa, Homo sapiens
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQMNLGKIVMDFKHPDGIAVPVMLPRRSLLVMTGESRYLWTHGITCRKFDTVQASESLKSGIITSDVGDLTLSKRGLRTSFTFRKVRQTPCNCKRRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 768360 - protein, 504 aa, Homo sapiens; identical to SEQ ID NO: 768359

SEQ ID NO: 768361 - protein, 315 aa, Homo sapiens
DSQRKETPPSFPESDKEASRLEQEYVHQVYEEIAGHFSSTRHTPWPHIVEFLKALPSGSIVADIGCGNGKYLGINKELYMIGCDRSQNLVDICRERQFQAFVCDALAVPVRSGSCDACISIAVIHHFATAERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 768362 - protein, 315 aa, Homo sapiens; identical to SEQ ID NO: 768361

SEQ ID NO: 768363 - protein, 203 aa, Homo sapiens
MSHAEDDRYRPARALARIERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 768364 - protein, 150 aa, Homo sapiens
LWKLCSLALCNKSCCCSLFGSTLPLRAVTLTAKVCSFTPEASETTNPPGGTNNSRCAALRAVTLTAKVCSFSPKPARPRTHQKEETLNTSKHQKEQTLDMPPLRTVTLTTRVRGFILEVSETKNPPIPDTFWQPQRDYHLLPSGETIAKW

SEQ ID NO: 768365 - protein, 119 aa, Homo sapiens
PLPPPLPQGSSFPLGAPLFLDGRADATAPLSCPQGVLSLGGGRRPGLWSHSQALLRTTWCPSQSSSECPEYGDKKVKPACLLTQWNILWPNQRKTLRILVTPGNVLLREKSRTTMLCGY

SEQ ID NO: 768366 - protein, 334 aa, Homo sapiens
SHEGELPDGEVPFLSPKEEPLKKRKRKERQVRHGSHPALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSDGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKPLVSVQA

SEQ ID NO: 768367 - protein, 839 aa, Homo sapiens
MALTQGQVTFRDVAIEFSQEEWTCLDPAQRTLYRDVMLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSDGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 768368 - protein, 113 aa, Homo sapiens
AHARTGSRRLLTKCFHCDHCYLCWVQVPKCHPSLSRGAGAQAVPRPPCGLGVHTLPKPLPWCRAGRRRTRAPPRNSGLCPNLKDHQEENFQRPLAQEWPVSLGIGFQAEARPE

SEQ ID NO: 768369 - protein, 161 aa, Homo sapiens
MNPGGRACSEPRLHHCTPAWATEQDSVSKKKKKEGVRVSSPIELLLSEAECIPRSFCRGLATPSQPQWMGKLLSPLEVQFLTPRVSAGLEAKLALNCIDSSGARGGDLESQSAASGRHHKCPQAWAGWPSSFTLGDGHLKQNSGGFASVLCFHLIVGGEVG

SEQ ID NO: 768370 - protein, 190 aa, Homo sapiens
SCVTLCEHYLTTTLMGYLSTGCLPTLGGSPLPFVLSPCMRPETNVPPMWLNPRLFPLASPQGWHTSCGPPRPVRPFLGPHVYSPSGHSVELAGSSESSGVPDPQEHQYSAQTSRDPVGMRRKGASWVWARDTPAARGSGGSAGLAMPAGRRTVGRHSSLGVQALRLEVGRVAYCLLWTSCRKIGRDCRCY

SEQ ID NO: 768371 - protein, 73 aa, Homo sapiens
HASRTRGSTHACANMVFRRFVWRLAGWPIVSFGPHAGKLVAIVDVIDQNRALVDGPCTSSEETGHAFQVHAAH

SEQ ID NO: 768372 - protein, 222 aa, Homo sapiens
MVFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKSSPKKAPGTKGTAAAAAAAAAAAAAAAAAKVPAKKITAASKKAPAQKVPAQKATGQKAAPAPKAQKGQKAPAQKAPAPKASGKKA

SEQ ID NO: 768373 - protein, 104 aa, Homo sapiens
LLNPRPYDLPKKHLVLRVLLLLLLLAAAAAAAAAAAAAAAAAKVPAKKRSPPRVKRLQAQKVPAQKGQQARKAAPAPKKLQKGQKSSRPRKAPASKRASGQGKA

SEQ ID NO: 768374 - protein, 62 aa, Homo sapiens
MDLALQVRRQAMPFKCMQLTDFILKFPHSAHQKYVRQAWQKADINTHVQPGTETRHSLLLAH

SEQ ID NO: 768375 - protein, 100 aa, Homo sapiens
LYSLLPPDLPLTLAELGSLCECLSLEVPPSGGLSSWSRPALGPLCEISMLSGDPKSFLTCSVSSNLPMSDVRLLLLLLLLLLLLLLLLLKFQQQKDHRRE

SEQ ID NO: 768376 - protein, 96 aa, Homo sapiens
TKSTAAPPKKAPGTKGTAAAAAAAAAAAAAAAAAKVPAKKRSPPRVKRLQAQKVPAQKGQQARKAAPAPKKLQKGQKSSRPRKAPASKRASGQGKA

SEQ ID NO: 768377 - protein, 91 aa, Homo sapiens
GSPGMHRPACCCAAAAAAAAAAAAAAAAAKVPAKKRSPPRVKRLQAQKVPAQKGQQARKAAPAPKKLQKGQKSSRPRKAPASKRASGQGKA

SEQ ID NO: 768378 - protein, 90 aa, Homo sapiens
LHPITADPPNRQPRHQCGASAAGATTPSQRSQLEAYSTLLANMGSLSQTPGHKGLCHGAATALLLLLLLLLLLLLLLLLKFQQQKDHRRE

SEQ ID NO: 768379 - protein, 151 aa, Homo sapiens
QIHLKSVSGPIEVLLVNRHGAHPLWLCLCHHLKIAPEPICCFYTPPLPKPALAQSQEASRPNSPQLTPTAVPGSAEVQGMAGPAAEITVSGGPGTDSKDSGELQFTPTGPNNTGHPATAVFCPLLLLLLLLLLLLLLLLLKFQQQKDHRRE

SEQ ID NO: 768380 - protein, 82 aa, Homo sapiens
GGAFFYTCAGLGGSSSFSPNAANMVFRRFVWRLAGWPIVSFGPHAGKLVAIVDVIDQNRALVDGPCTSSEETGHAFQVHAAH

SEQ ID NO: 768381 - protein, 82 aa, Homo sapiens; identical to SEQ ID NO: 768380

SEQ ID NO: 768382 - protein, 82 aa, Homo sapiens; identical to SEQ ID NO: 768380

SEQ ID NO: 768383 - protein, 82 aa, Homo sapiens; identical to SEQ ID NO: 768380

SEQ ID NO: 768384 - protein, 139 aa, Homo sapiens
SSSSWFGVYSERWCLAVSERWCLAVSDRWCLAVSDRWCLARATLSCFGCAMPMYQVKPYHGVCAPLRTVPTRSMSDKPGRRQTSIQNGQPHDGPRRLKPRERKAKMTDFDRFKVMKATEHNEEQNNQRMKLRSFKRQLS

SEQ ID NO: 768385 - protein, 71 aa, Homo sapiens
GRENKSTARCEAGWCAAGERVEGPAGLARLGPRVRASAAGAGWLMRLVVREPCPAVWALRTWELVGVGNRA

SEQ ID NO: 768386 - protein, 81 aa, Homo sapiens
YPSTLYTSGLWSMDLALQVRRQAMPFKCMQLTDFILKFPHSAHQKYVRQAWQKADINTKWAATRWAKKIEAQRKESQDDRF

SEQ ID NO: 768387 - protein, 85 aa, Homo sapiens
GPRVYHAVLISPGLWSMDLALQVRRQAMPFKCMQLTDFILKFPHSAHQKYVRQAWQKADINTKWAATRWAKKIEAQRKESQDDRF

SEQ ID NO: 768388 - protein, 71 aa, Homo sapiens; identical to SEQ ID NO: 768385

SEQ ID NO: 768389 - protein, 98 aa, Homo sapiens
LWKHQFAWPFRQPVDAVKLGLPIPTSGWERTTVAKILSFFLSLMQPMDSQPQRFPPRVGRGPRWPKFLASSFPSCSPWIASPRGLSQNYKTAYGHGYY

SEQ ID NO: 768390 - protein, 71 aa, Homo sapiens; identical to SEQ ID NO: 768385

SEQ ID NO: 768391 - protein, 73 aa, Homo sapiens; identical to SEQ ID NO: 768371

SEQ ID NO: 768392 - protein, 190 aa, Homo sapiens; identical to SEQ ID NO: 768370

SEQ ID NO: 768393 - protein, 91 aa, Homo sapiens; identical to SEQ ID NO: 768377

SEQ ID NO: 768394 - protein, 61 aa, Homo sapiens
MSDKPGRRQTSIQNGQPHDGPRRLKPRERKAKMTDFDRFKVMKATEHNEEQNNRRSRDGPA

SEQ ID NO: 768395 - protein, 94 aa, Homo sapiens
HASRTRGSTHACANMAAAAAAAAAAAAAAAAAKVPAKKRSPPRVKRLQAQKVPAQKGQQARKAAPAPKKLQKGQKSSRPRKAPASKRASGQGKA

SEQ ID NO: 768396 - protein, 85 aa, Homo sapiens
DLFNCPSLNVKKHCQAPPLRLESMSPDEQNSQTPISDPNSNDGQSDPLPNSSNSVVPLLLLLLLLLLLLLLLLLKFQQQKDHRRE

SEQ ID NO: 768397 - protein, 82 aa, Homo sapiens; identical to SEQ ID NO: 768380

SEQ ID NO: 768398 - protein, 82 aa, Homo sapiens; identical to SEQ ID NO: 768380

SEQ ID NO: 768399 - protein, 82 aa, Homo sapiens; identical to SEQ ID NO: 768380

SEQ ID NO: 768400 - protein, 82 aa, Homo sapiens; identical to SEQ ID NO: 768380

SEQ ID NO: 768401 - protein, 229 aa, Homo sapiens
MLLIRTGLWSMDLALQVRRQAMPFKCMQLTDFILKFPHSAHQKYVRQAWQKADINTKWAATRWAKKIEAQRKGKAKMTDFDPLQGYAQGKAHMRQQEHHSKELHTLRKPFKQGQALPVKAFSQRKAPWVTKGVNLTAEMPDCLLALLPYTVPDEHTAFTGTPTLQKGLARPRQGFPVPESAPQAQKYDAALGSQTRAHDIGRAKDDVHRRQGKRTQVPKGARSGQKAQA

SEQ ID NO: 768402 - protein, 191 aa, Homo sapiens
MLLIRTGLWSMDLALQVRRQAMPFKCMQLTDFILKFPHSAHQKYVRQAWQKADINTKWAATRWAKKIEAQRKAKAKMTDFDRFDSYEGDMDECVVLLRNFGAGDPLIIFKYYGKVAEGPEVGFKDREGDFFMRSRVAVIIKVGDSHTTRKMSSGEEPRAFRSEHPLGATGGPLTGDPITRVLLRELLSIVP

SEQ ID NO: 768403 - protein, 190 aa, Homo sapiens; identical to SEQ ID NO: 768370

SEQ ID NO: 768404 - protein, 73 aa, Homo sapiens; identical to SEQ ID NO: 768371

SEQ ID NO: 768405 - protein, 70 aa, Homo sapiens
ASGCRRPPANGLRGRSGAAAPTFPGLRGSRDLVALWVSGGEQAPNLAEGTQAEPSGLPQDPVTWIAGGWR

SEQ ID NO: 768406 - protein, 68 aa, Homo sapiens
RRQEIEQKLEVQEEERKQVENERRELFEERRAKQTELRLLEQKVELRSCKKNGMNIIAGHEISRDRRL

SEQ ID NO: 768407 - protein, 79 aa, Homo sapiens
SAAARVGLWSMDLALQVRRQAMPFKCMQLTDFILKFPHSAHQKYVRQAWQKADINTKWAATRWAKKIEAQRKESQDDRF

SEQ ID NO: 768408 - protein, 71 aa, Homo sapiens; identical to SEQ ID NO: 768385

SEQ ID NO: 768409 - protein, 71 aa, Homo sapiens; identical to SEQ ID NO: 768385

SEQ ID NO: 768410 - protein, 71 aa, Homo sapiens; identical to SEQ ID NO: 768385

SEQ ID NO: 768411 - protein, 101 aa, Homo sapiens
LSVPASRGVPPPTAMGVLRARGEEGLALSPFLAGGASRLCDGAPKSQGGKTGSLSVAASRGVPPALRWGSQEPGGDEGLALCTRLSMGASPPAIGVLRARG

SEQ ID NO: 768412 - protein, 175 aa, Homo sapiens
RKLGFTGSTPIGKQIMKSCAVSNLKKVSLELGGKSPLIIFNDCELDKAVRMGMGAVFFNKGENCIAAGRLFVEESIHDEFVTRVVEEIKKMKIGDPLDRSTDHGPQNHKAHLEKLLQYCETGVKEGATLVYGGRQVQRPGFFMEPTVFTDVEDYMYLAKEESFGPIMVISKFQNG

SEQ ID NO: 768413 - protein, 322 aa, Homo sapiens
GAPALAPRPPHQRRETRSSSRGRRTRRRRRSRRRMKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 768414 - protein, 231 aa, Homo sapiens
GAPALAPRPPHQRRETRSSSRGRRTRRRRRSRRRMKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDVSRGWGGLCFWKIFASPP

SEQ ID NO: 768415 - protein, 72 aa, Homo sapiens
RDSERRLTWESKAWLSCAHSGEGADPLRSAVKTSLQEATPASRGLWLRPLLNSGLAHHLRPSHPAVCAPYST

SEQ ID NO: 768416 - protein, 125 aa, Homo sapiens
MKIRRIPIERGSLPLTGTASGGSPGRAKRGSPAPTRESKQWLTCAHPGEQAWLTCAHSGKPAAILCCRQGAGGGRGADPLRSAVKTSLQEATPASRGLWLRPLLNSGLAHHLRPSHPAVCAPYST

SEQ ID NO: 768417 - protein, 172 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQVSASPLPSLVTGPITRAF

SEQ ID NO: 768418 - protein, 314 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKATDAMAHVAGFTVAHDVSARDWLTRRNGKQWLLGKTFDTFCPLGPALVTKDSVADPHNLKICCRVNGEVVQSSNTNQMVFKTEDLIAWVSQFVTFYPGDVILTGTPPGVGVFRKPPVFLKKGDEVQCEIEELGVIINKVV

SEQ ID NO: 768419 - protein, 406 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKVRWKGWAPGQSAAEAPAPASPSSDLTHRHMAPAVPDTRKQSASLLPDTAFPFTHLWLALATEHGITALRSLATGVGVTRDLTSCMAKSPAPKATDAMAHVAGFTVAHDVSARDWLTRRNGKQWLLGKTFDTFCPLGPALVTKDSVADPHNLKICCRVNGEVVQSSNTNQMVFKTEDLIAWVSQFVTFYPGDVILTGTPPGVGVFRKPPVFLKKGDEVQCEIEELGVIINKVV

SEQ ID NO: 768420 - protein, 314 aa, Homo sapiens; identical to SEQ ID NO: 768418

SEQ ID NO: 768421 - protein, 195 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKVRWKGWAPRPECSRGPSSCLS

SEQ ID NO: 768422 - protein, 406 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKVRWKGWAPRPECTEAPAPASPSSDLTHRHMAPAVPDTRKQSASLLPDTAFPFTHLWLALATEHGITALRSLATGVGVTRDLTSCMAKSPAPKATDAMAHVAGFTVAHDVSARDWLTRRNGKQWLLGKTFDTFCPLGPALVTKDSVADPHNLKICCRVNGEVVQSSNTNQMVFKTEDLIAWVSQFVTFYPGDVILTGTPPGVGVFRKPPVFLKKGDEVQCEIEELGVIINKVV

SEQ ID NO: 768423 - protein, 152 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVSHSA

SEQ ID NO: 768424 - protein, 314 aa, Homo sapiens; identical to SEQ ID NO: 768418

SEQ ID NO: 768425 - protein, 265 aa, Homo sapiens
MLVSGRRRLLTALLQAQKWPFQPSRDMRLVQFRAPHLVGPHLGLETGNGGGVINLNAFDPTLPKTMTQFLEQGEATLSVARRALAAQLPVLPWSEVTFLAPVTWPDKVVCVGMNYVDHCKEQNVPVPKEPIIFSKFASSIVGPYDEVVLPPQSQEVDWEVELAVVIGKKGKHIKATDAMAHVAGFTVAHDVSARDWLTRRNGKQWLLGKTFDTFCPLGPALVTKDSVADPHNLKICCRVNGEVVQSSNTNQMVFKTEDLIAWVSQ

SEQ ID NO: 768426 - protein, 65 aa, Homo sapiens
MQAAEISLEEKDQRIGELDRLIERMEKVGHSVGPIAHLPKLFPVGPSEIREALDMDSSHLQNLQL

SEQ ID NO: 768427 - protein, 408 aa, Homo sapiens
PSRVAPAQGGPRTLILPGRNAGVQPATDRRCGMLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKSSRWSRRLNH

SEQ ID NO: 768428 - protein, 464 aa, Homo sapiens
GQFRRVTVRTGQERRGGGKMAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 768429 - protein, 464 aa, Homo sapiens; identical to SEQ ID NO: 768428

SEQ ID NO: 768430 - protein, 464 aa, Homo sapiens; identical to SEQ ID NO: 768428

SEQ ID NO: 768431 - protein, 464 aa, Homo sapiens; identical to SEQ ID NO: 768428

SEQ ID NO: 768432 - protein, 464 aa, Homo sapiens; identical to SEQ ID NO: 768428

SEQ ID NO: 768433 - protein, 464 aa, Homo sapiens; identical to SEQ ID NO: 768428

SEQ ID NO: 768434 - protein, 464 aa, Homo sapiens; identical to SEQ ID NO: 768428

SEQ ID NO: 768435 - protein, 464 aa, Homo sapiens; identical to SEQ ID NO: 768428

SEQ ID NO: 768436 - protein, 109 aa, Homo sapiens
YGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGMCDIQGRDPNKT

SEQ ID NO: 768437 - protein, 464 aa, Homo sapiens
LQVVKTLLDFGCHPSLQDSEGDTPLHDAISKKRDDILAVLLEAGADVTITNNNGFNALHHAALRGNPSAMRVLLSKLPRPWIVDEKKDDGYTALHLAALNNHVEVAELLVHQGNANLDIQNVNQQTALHLAVERQHTQIVRLLVRAGAKLDIQDKDGDTPLHEALRHHTLSQLRQLQDMQDVGKVDAAWEPSKNTLIMGLGTQGAEKKSAASIACFLAANGADLSIRNKKGQSPLDLCPDPNLCKALAKCHKEKVSGQVGSRSPSMISNDSETLEECMVCSDMKRDTLFGPCGHIATCSLCSPRVKKCLICKEQVQSRTKIEECVVCSDKKAAVLFQPCGHMCACENCANLMKKCVQCRAVVERRVPFIMCCGGKSSEDATDDISSGNIPVLQKDKDNTNVNADVQKLQQQLQDIKEQTMCPVCLDRLKNMIFLCGHGTCQLCGDRMSECPICRKAIERRILLY

SEQ ID NO: 768438 - protein, 735 aa, Homo sapiens
FFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 768439 - protein, 735 aa, Homo sapiens; identical to SEQ ID NO: 768438

SEQ ID NO: 768440 - protein, 106 aa, Homo sapiens
QLSPSSSALEGNRLKRQRRDLGEGRERAFRKRELTSEKEHRTGGGALWFSSLPCRRLGHPFLPGSVSPSLHPSLEGMAQRLHRSLGFCRARESPYFGKGELLLHGS

SEQ ID NO: 768441 - protein, 108 aa, Homo sapiens
CWEELPRCAEGPVLRKRNRESSTALEKHPNSPMTAKQILEVIQKEGLKETSSGRQKAQIKVGSVRFCFRPRHGLETALVCMKDLPPMKDLGQLSMMIILEPQLLSCWS

SEQ ID NO: 768442 - protein, 80 aa, Homo sapiens
MLNRMLELAGVAGIALEWFRSFLPVCSKQVTDEASSTRDSSLTNTAVQSKLVSSFQQHTKKALKQALRQQQKRRNGVSMM

SEQ ID NO: 768443 - protein, 132 aa, Homo sapiens
MKDKRKKKDRTWAEAARLALEKHPNSPMTAKQILEVIQKEGLKETSGTSPLACLNAMLHTNTRIGDGTFFKIPGKSGLYALKKEESSCPADGTLDLVCESELDGTDMAEANAHGEENGVMFGTTLQVQKMCI

SEQ ID NO: 768444 - protein, 707 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVREAERAVTHWVIKNKPELHFSLNTLLIKTMVPNQVSLRARRDCGVIARVP

SEQ ID NO: 768445 - protein, 707 aa, Homo sapiens; identical to SEQ ID NO: 768444

SEQ ID NO: 768446 - protein, 707 aa, Homo sapiens; identical to SEQ ID NO: 768444

SEQ ID NO: 768447 - protein, 724 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 768448 - protein, 314 aa, Homo sapiens
GRTLGCELIPDVLMTYSSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 768449 - protein, 724 aa, Homo sapiens; identical to SEQ ID NO: 768447

SEQ ID NO: 768450 - protein, 634 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVPM

SEQ ID NO: 768451 - protein, 174 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLFLFSCVPFSLGQLSP

SEQ ID NO: 768452 - protein, 228 aa, Homo sapiens
MLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 768453 - protein, 195 aa, Homo sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATANSVPEMKLLRQITMNRLFPTLNHKLTEGSGPHFQSI

SEQ ID NO: 768454 - protein, 163 aa, Homo sapiens
MPCESSAIVTVVLATVTHQQQLLLSSSSSSSSSSSPPPPSPSPTNNTTIIHSQGHLVILAFYGREYVEFGSGRNMETIMQTSETGSDTGSTVTLQTSVASQAAVPTQVVQQVPVQQQVQQVQTVQQVQHVYPAQVQYVEGSDTVYTNGAMSRAPWSMILESSP

SEQ ID NO: 768455 - protein, 139 aa, Homo sapiens
CGPVAPGRPLLTRVRGLPRACTVGPEPRRGPGHAWGQRWRRRSGGVGRVRVQSPPHGRPAPRLPVTPTSLAPRAGTSAGSAPGRARFLGTRAVVPAPRRAFRHRRAFVLHPSPLFPTPRLTRAAPKWPCPPAWTTPQCP

SEQ ID NO: 768456 - protein, 144 aa, Homo sapiens
MRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAHDGSATYLRFIIVSAFDHFASVHSVSAEGTVVSNLSS

SEQ ID NO: 768457 - protein, 189 aa, Homo sapiens
QGWAGEARVRGPRHEGGAGPGGGARPRAGDPRAEGLELAEVKHFKMRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAHDGSATYLRFIIVSAFDHFASVHSVSAEGTVVSNLSS

SEQ ID NO: 768458 - protein, 159 aa, Homo sapiens
LSTPGTKLGRVKHFKMRKIDLCLSSEGSEVILATSSDEKHPPENIIDGNPETFWTTTGMFPQEFIICFHKHVRIERLVIQSYFVQTLKIEKSTSKEPVDFEQWIEKDLVHTEGQLQNEEIVAHDGSATYLRFIIVSAFDHFASVHSVSAEGTVVSNLSS

SEQ ID NO: 768459 - protein, 144 aa, Homo sapiens; identical to SEQ ID NO: 768456

SEQ ID NO: 768460 - protein, 144 aa, Homo sapiens; identical to SEQ ID NO: 768456

SEQ ID NO: 768461 - protein, 144 aa, Homo sapiens; identical to SEQ ID NO: 768456

SEQ ID NO: 768462 - protein, 131 aa, Homo sapiens
RGRSERARELGGASAPGNSVEAAVAGWGGAEGRAGPVGVVAQRARGRSARPETQRWPRRRGGAEGGTGLVGGVARRFQSWSARDPGLHGGRGEQAELRVGTLCVGRGAREVSSPEGPAPRANGSPRLNTLR

SEQ ID NO: 768463 - protein, 144 aa, Homo sapiens; identical to SEQ ID NO: 768456

SEQ ID NO: 768464 - protein, 101 aa, Homo sapiens
RLGRGGARARAPARRRGRTWRRGQAQGRRPEGRGFGTRRGGPCACVLAGGWVPWVLRAPGIELSWGRVGSARPGTGLGKGAQEWFRILAREVMGAGEGGAD

SEQ ID NO: 768465 - protein, 104 aa, Homo sapiens [sequence omitted]

SEQ ID NO: 768466 - protein, 316 aa, Homo sapiens
RQAWHEAMEQLLRAELRTATLRAFGGPGAGCISEGRAYDTDAGPVFVKVNRRTQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQVNEWQDDWPTFFARHRLQAQLDLIEKDYADREARELWSRLQVKIPDLFCGLEIVPALLHGDLWSGNVAEDDVGPIIYDPASFYGHSEFELAIALMFGGFPRSFFTAYHRKIPKAPGFDQRLLLYQLFNYLNHWNHFGREYRSPSLGTMRRLLK

SEQ ID NO: 768467 - protein, 238 aa, Homo sapiens
MATATERTTREEWTRTGATTDTPDPQPHSASRAPETDRGERQSRPARADTATAPQRTPDRGADAQPHLLRQSMEESDRAPKQTCQTRGPTAQAQPPAYRYKRTHEGRRPTSQKDCSRTGRAQEWGTRASVAGSHVRAQPTQLTRAARLAVTAQISDDETHELRRLRQKYTEATTASRGQRCRRMRRQRQGLDGTGSRERGVGIDEATRLAGRSSWRQQESAKRRERAQRGIPAERVAR

SEQ ID NO: 768468 - protein, 238 aa, Homo sapiens; identical to SEQ ID NO: 768467

SEQ ID NO: 768469 - protein, 316 aa, Homo sapiens; identical to SEQ ID NO: 768466

SEQ ID NO: 768470 - protein, 520 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 768471 - protein, 124 aa, Homo sapiens
KKFRVQRHLVKWTGCGEGPAASAFCSSHATSQPRAGGPRGKTQHLPQGIRAEKRPAFRPSCRIISSCPGHLSDKMMASMSIMLEGTIHRHGDILPRRHEGGLARQLEPLRIKGPSSGSLSPLPK

SEQ ID NO: 768472 - protein, 149 aa, Homo sapiens
SKHQVEQGLLPGLTSWAIVGKQWQQAASSLASPDWAVCEASLWVWGRWGTPLPLTRRGFLLAVGVGSSAEPSRHGCPLFWEEGSAPRPQESRQRPPKPDCQQKPSPSEGQVGVPQVPTPTGRLHTLPSTGDARRQAPLLLPLLPTLPSL

SEQ ID NO: 768473 - protein, 107 aa, Homo sapiens
PPPPNLMWMYLFWWKSPNLGRSVNSFCPPFDGPPPAKCVVCPLSQVDVYRVLYNFLAPSLNMPSPTFFPSESHPGIQCINPISCLVHNSSKGSYFVNYISSVHYHIM

SEQ ID NO: 768474 - protein, 70 aa, Homo sapiens
DLEDPRSARWRVPMIKGLYGIKDDVFLSVPCILGQNGISDLVKVTLTSEEEARLKKSADTLWGIQKELQF

SEQ ID NO: 768475 - protein, 205 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGSSPIKLSWGGSLGNMEIPAVPVWDVE

SEQ ID NO: 768476 - protein, 205 aa, Homo sapiens; identical to SEQ ID NO: 768475

SEQ ID NO: 768477 - protein, 205 aa, Homo sapiens; identical to SEQ ID NO: 768475

SEQ ID NO: 768478 - protein, 205 aa, Homo sapiens; identical to SEQ ID NO: 768475

SEQ ID NO: 768479 - protein, 234 aa, Homo sapiens
MGEPSGGYTYTQTSIFLFHAKIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGSSPIKLSWGGSLGNMEIPAVPVWDVE

SEQ ID NO: 768480 - protein, 205 aa, Homo sapiens; identical to SEQ ID NO: 768475

SEQ ID NO: 768481 - protein, 205 aa, Homo sapiens; identical to SEQ ID NO: 768475

SEQ ID NO: 768482 - protein, 205 aa, Homo sapiens; identical to SEQ ID NO: 768475

SEQ ID NO: 768483 - protein, 205 aa, Homo sapiens; identical to SEQ ID NO: 768475

SEQ ID NO: 768484 - protein, 147 aa, Homo sapiens
MATLKDQLIYNLLKEEQTPQNKITVVGVGAVGMACAISILMKDLADELALVDVIEDKLKGEMMDLQHGSLFLRTPKIVSGKVDILTYVAWNDKWFSQKPCYWKWLQSGFSPIPLPDGGKAGSSPIKLSWGGSLGNMEIPAVPVWDVE

SEQ ID NO: 768485 - protein, 205 aa, Homo sapiens; identical to SEQ ID NO: 768475

SEQ ID NO: 768486 - protein, 205 aa, Homo sapiens; identical to SEQ ID NO: 768475

SEQ ID NO: 768487 - protein, 186 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGMPVWDVE

SEQ ID NO: 768488 - protein, 205 aa, Homo sapiens; identical to SEQ ID NO: 768475

SEQ ID NO: 768489 - protein, 205 aa, Homo sapiens; identical to SEQ ID NO: 768475

SEQ ID NO: 768490 - protein, 205 aa, Homo sapiens; identical to SEQ ID NO: 768475

SEQ ID NO: 768491 - protein, 205 aa, Homo sapiens; identical to SEQ ID NO: 768475

SEQ ID NO: 768492 - protein, 205 aa, Homo sapiens; identical to SEQ ID NO: 768475

SEQ ID NO: 768493 - protein, 205 aa, Homo sapiens; identical to SEQ ID NO: 768475

SEQ ID NO: 768494 - protein, 205 aa, Homo sapiens; identical to SEQ ID NO: 768475

SEQ ID NO: 768495 - protein, 160 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYLPSQAESVYPMAATG

SEQ ID NO: 768496 - protein, 207 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGSSPIKLSWGGSLGNMEIPAGSVCLLEWH

SEQ ID NO: 768497 - protein, 93 aa, Homo sapiens
ESLMAYGAAAAAADSGSHCHAPPTTARRAFPIPFGSKSNMATLKDQLIYNLLKEEQTPQNKITVVGVGAVGMACAISILMKVSESLPHWKPIP

SEQ ID NO: 768498 - protein, 205 aa, Homo sapiens; identical to SEQ ID NO: 768475

SEQ ID NO: 768499 - protein, 205 aa, Homo sapiens; identical to SEQ ID NO: 768475

SEQ ID NO: 768500 - protein, 205 aa, Homo sapiens; identical to SEQ ID NO: 768475

SEQ ID NO: 768501 - protein, 205 aa, Homo sapiens; identical to SEQ ID NO: 768475

SEQ ID NO: 768502 - protein, 205 aa, Homo sapiens; identical to SEQ ID NO: 768475

SEQ ID NO: 768503 - protein, 205 aa, Homo sapiens; identical to SEQ ID NO: 768475

SEQ ID NO: 768504 - protein, 205 aa, Homo sapiens; identical to SEQ ID NO: 768475

SEQ ID NO: 768505 - protein, 205 aa, Homo sapiens; identical to SEQ ID NO: 768475

SEQ ID NO: 768506 - protein, 205 aa, Homo sapiens; identical to SEQ ID NO: 768475

SEQ ID NO: 768507 - protein, 205 aa, Homo sapiens; identical to SEQ ID NO: 768475

SEQ ID NO: 768508 - protein, 155 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSH

SEQ ID NO: 768509 - protein, 205 aa, Homo sapiens; identical to SEQ ID NO: 768475

SEQ ID NO: 768510 - protein, 205 aa, Homo sapiens; identical to SEQ ID NO: 768475

SEQ ID NO: 768511 - protein, 205 aa, Homo sapiens; identical to SEQ ID NO: 768475

SEQ ID NO: 768512 - protein, 205 aa, Homo sapiens; identical to SEQ ID NO: 768475

SEQ ID NO: 768513 - protein, 205 aa, Homo sapiens; identical to SEQ ID NO: 768475

SEQ ID NO: 768514 - protein, 227 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGSSPIKLSWGGSLGNMEIPAVPARSGMMVPGLPENRTQNRGCWTRHRFR

SEQ ID NO: 768515 - protein, 161 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWQISGFPMMGERLG

SEQ ID NO: 768516 - protein, 256 aa, Homo sapiens
MGEPSGGYTYTQTSIFLFHAKIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWNDKWFSQKPCYWKWLQSGFSPIPLPDGGKAGSSPIKLSWGGSLGNMEIPAVPARSGMMVPGLPENRTQNRGCWTRHRFR

SEQ ID NO: 768517 - protein, 119 aa, Homo sapiens
MPEILLFRNVYVGVSIVCSLFFFQDFVKSFRRDSSRGKRWLGAPKCTSVRKETEPQEDPLGLAKLQTRAAQERNISHWLSLRRSYRGLNHRALFPAGISFPRGEFSTKSLLEQHAGGGG

SEQ ID NO: 768518 - protein, 206 aa, Homo sapiens
HERTHTREKPYECKECGKAFIYLASFQRHMIMHSGDGPYKCEECGKAFSCPSSFQVPERIHTREKPYECKQCGKAFSWLGSFRVHERTHTGEKPCECNECGKAFIYRTTLKGHMNIHTGEKPYKCEQCEKAFLSLASFQMHMIMHTGDAPYKCNECGKAFNCLNSFQIHERTHTGEKPYECKQCGKAFSCSSSFRIHERSHSGEKP

SEQ ID NO: 768519 - protein, 75 aa, Homo sapiens
EISEKDDQSQHNSDEEPESNVSVDQEIDAEEVNSVQTAVKNLATAFMIIHHPESTPHQSKETQPEIGSSQESADA

SEQ ID NO: 768520 - protein, 126 aa, Homo sapiens
RLQVRPQGSAFPSPKVTSVWPCGCHSPLWSQLCAVTCRGWTAATSCPSWHDGRMRLSDLQVYGETRLRDVEEKPGRALFIPFLSFFNLKEGKSFINSNKGMPYNFPTILCSDGISFHLFFHSGGRV

SEQ ID NO: 768521 - protein, 246 aa, Homo sapiens
SLPRRSHPLLRAELAAAMTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 768522 - protein, 246 aa, Homo sapiens; identical to SEQ ID NO: 768521

SEQ ID NO: 768523 - protein, 246 aa, Homo sapiens; identical to SEQ ID NO: 768521

SEQ ID NO: 768524 - protein, 246 aa, Homo sapiens; identical to SEQ ID NO: 768521

SEQ ID NO: 768525 - protein, 161 aa, Homo sapiens
AVQLACCGRSRGSPHALSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 768526 - protein, 118 aa, Homo sapiens
MVDVSWWANTIFFFPAGRAVPLVFYITYTRGTVDRSSEQTDEDRNDADRKSTHNEKAKESNRMAEWIKDSRNREDYISSRGGKGDDMPVQQESRVRRIQNTRVATTGRTNVRETSRNY

SEQ ID NO: 768527 - protein, 74 aa, Homo sapiens
DRRRSFESTDKMCLLCLYQKMKGIEIKGEIEVFHARPCEETTKQALCEQHGCLFHLGAGGLSPKRESAKGVGYH

SEQ ID NO: 768528 - protein, 290 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 768529 - protein, 290 aa, Homo sapiens; identical to SEQ ID NO: 768528

SEQ ID NO: 768530 - protein, 290 aa, Homo sapiens; identical to SEQ ID NO: 768528

SEQ ID NO: 768531 - protein, 199 aa, Homo sapiens
AHGLQLWVGSSEQGISEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 768532 - protein, 263 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHAIISVHIGTI

SEQ ID NO: 768533 - protein, 191 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGAR

SEQ ID NO: 768534 - protein, 290 aa, Homo sapiens; identical to SEQ ID NO: 768528

SEQ ID NO: 768535 - protein, 290 aa, Homo sapiens; identical to SEQ ID NO: 768528

SEQ ID NO: 768536 - protein, 108 aa, Homo sapiens
AGTISPQWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 768537 - protein, 257 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHVRPK

SEQ ID NO: 768538 - protein, 266 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHALWILNLKARRKK

SEQ ID NO: 768539 - protein, 101 aa, Homo sapiens
KLGGLTSRPRPLRGAVLAAHLGFNTSLGGTIYIMDPGPGLLQKGQLKERRTLFLEKNTDGFLFLFSPRFTLAHQPYIWTSNWTQEPNIPNLSLKGMMGSGV

SEQ ID NO: 768540 - protein, 563 aa, Homo sapiens
MANAEVSVPVGDVVVVPTEGNEGENPEDTKTQVILQLQPVQQGIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 768541 - protein, 66 aa, Homo sapiens
SIPLRGHGSITQIAISEESMEEAGLEWNSALTAAVTMATEEGVKKDSEEISEDTLMFWNRIADEGV

SEQ ID NO: 768542 - protein, 573 aa, Homo sapiens
MANAEVSVPVGDVVVVPTEGNEGENPEDTKTQVILQLQPVQQGLFIDGHFYNRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 768543 - protein, 609 aa, Homo sapiens
MDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGWSTMVRSRLTATSASRVQAILLPQPPK

SEQ ID NO: 768544 - protein, 700 aa, Homo sapiens
LQFHPFQGSVSFNDVTVDFTQEEWQHLDHAQKTLYMDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKSARAFSHNEVFMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGWSTMVRSRLTATSASRVQAILLPQPPK

SEQ ID NO: 768545 - protein, 116 aa, Homo sapiens
MELEGQWWRGQLAADIHQALRYKELKLPSYKGQSPQLSLRRYFADLIAIVSNRFTLCPSARHLAVYLLDLFMDRYDISIQQLHLVALSCLLLASKYERNTKTAVPKSGAQQPGFVD

SEQ ID NO: 768546 - protein, 299 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 768547 - protein, 299 aa, Homo sapiens; identical to SEQ ID NO: 768546

SEQ ID NO: 768548 - protein, 209 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKVKSFVVKREKRLHISAMYDYKFCSLFPRISSTHIKCLSSHNHNRYRVHFVHILLYGSKGLS

SEQ ID NO: 768549 - protein, 116 aa, Homo sapiens [sequence omitted]

SEQ ID NO: 768550 - protein, 209 aa, Homo sapiens; identical to SEQ ID NO: 768548

SEQ ID NO: 768551 - protein, 299 aa, Homo sapiens; identical to SEQ ID NO: 768546

SEQ ID NO: 768552 - protein, 170 aa, Homo sapiens [sequence omitted]

SEQ ID NO: 768553 - protein, 299 aa, Homo sapiens; identical to SEQ ID NO: 768546

SEQ ID NO: 768554 - protein, 299 aa, Homo sapiens; identical to SEQ ID NO: 768546

SEQ ID NO: 768555 - protein, 299 aa, Homo sapiens; identical to SEQ ID NO: 768546

SEQ ID NO: 768556 - protein, 150 aa, Homo sapiens [sequence omitted]

SEQ ID NO: 768557 - protein, 70 aa, Homo sapiens
APSPVGPTLNVTRCRYSPDFKYVALVLQSVSKKMNEKSKKSDQKYKPITTLQDKTSNFQNCWTEMIIIYT

SEQ ID NO: 768558 - protein, 227 aa, Homo sapiens
MLLKCLHNNLCQKYSAHAFQFSPRNVLWLLVVCLRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFV

SEQ ID NO: 768559 - protein, 157 aa, Homo sapiens
ICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVV

SEQ ID NO: 768560 - protein, 377 aa, Homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 768561 - protein, 716 aa, Homo sapiens
MKAILGAFFKCKKSVIIVEKLVRESYFYGFEKEGVFALRLNYSIMLLCCYGGFLVCYRSPKEKASEQVTGQPQLTALNKSRITSSFNKIISKDCLLFKLIPPINTHTRVHTHTTHTHRAVSRTSFPFSVVVSSEIPHVLQDRYYRYDRIRFHLSQKVISCYMCQLKCLSINRYLSDKLLMLTIVPPLRSSNQTKSVTIERGYLTVKDGQHRAVHSLQQREKKCSWHNFITGFIYIIPVQWKLFFDLPLPDYKVVNCATSASHCFVLINRREPAKILRNTGAGRQCFNLTILPILAPTPPIDSQLTFFLPPGNGGLEEVKVRKVKHLITTGTCSTREGTHPGVGGVGIATRFDSSHLQRKKNKPKPESNPSLTVVQYLRASWLEFSFPSAHNHLELAINKQPDNLTSISIDIKCKHSFILSVRNSNFSLISNIISQFNLCTDMDISLGICQIQECIFLRSIEIRHFKSGKITYKLVGITVEASQKIPQNRWHGVHADSHGVILWSFNIEAVFQINKTNWGIKYKQMDVTEAPPQKKPSITNLKKIFSLTNLCSFQLFYLFLPVRESLILKSWIIEEKFYPLNRIHPQFMVYVKKMYDYEISLQLFADIAKSLLGIYIILVFYKNTSVTRPKSNLTIKQLLFSLKTHNLKIYLSENCMVPELYFCVEMLFVSDGNKCTLLLCLLCLAVERMICPSYHWIMGMNALFKINLFINILILF

SEQ ID NO: 768562 - protein, 713 aa, Homo sapiens
MKAILGAFFKCKKSVIIVEKLVRESYFYGFEKEGVFALRLNYSIMLLCCYGGFLVCYRSPKEKASEQVTGQPQLTALNKSRITSSFNKIISKDCLLFKLIPPINTHTRVHTHTTHTHRAVSRTSFPFSVVVSSEIPHVLQDRYYRYDRIRFHLSQKVISCYMCQLKCLSINRYLSDKLLMLTIVPPLRSSNQNQIGEPLKDDIVTVKDGQHRAVHSLQQRDGSCFLTYLYQITKELTVPLQPPTVLFQLNRREPAKILRNTGAGRQCFNLTISPILAPTPPIDSQLTFFLPPGNGGLEEVKVRKVKHLITTGLVVPREGTHPGVGGVGIATRFDSSHLQRKKNKPKPESNPSLTVVQYLRASWLEFSFPSAHNHLELANNKQPDNLTSISIDIKCKHSFILSVRNSNFSLISNIISQFNLCTDMDISLGICQIQECIFLRSIEIRHFKSGKITYKLVGITVEASQKYPMNRWHGVHADSHGVILWSFNIEAVFQINKTNWGIKYKQMDVTEAPPQKKPSITNLKKIFSLTNLCSFQLFYLFLPVRESLILKSWIIEEKFYTLNRIHPQFMVYVKKMYDYEISLQLFADIAKSLLGIYIILVFYKNTSVTRPKSNLTIKQCFFLLKTTQPKDLSVIKLHGSRALFLCRDAICYVMETNYFVAMSFVSSSGENDMTIISLDYGNECPFQNKLIYEYFNIILYYNINNILILLLLL

SEQ ID NO: 768563 - protein, 108 aa, Homo sapiens
ECPDDGSDGPSGAAAVRTLAAAGEAQPGLRTRQSWCGSQEQMRAPPSTKLAVQKAALPGADAEFSSRPWHPWALRGPGSPQPLQASKGLLPLLGLSLLLATILGQSKA

SEQ ID NO: 768564 - protein, 31 aa, Homo sapiens
EKCRCLGNPKPSPSPERGKFGASPGGGAWRR

SEQ ID NO: 768565 - protein, 50 aa, Homo sapiens
MLVVVVRQRVRDTRKKARTRENPASGDQVEAEHGRRAWAPTPTPHIPGLL

SEQ ID NO: 768566 - protein, 293 aa, Homo sapiens
SCSCLPGWLARSLLGTQRSAGSTQRDLRAAVPSPDSRIPGARRPAAGAAMKKLMVVLSLIAAAWAEEQNKLVHGGPCDKTSHPYQAALYTSGHLLCGGVLIHPLWWCSLTSVPTVQKTLNLQVFLGKHNLRQRESSEEQSSVVRAVIHPDYDAASHDQDIMLLRLAAQPNSLNSSSPFPWRGTAQPTPPAATSWAGARQQMVISLTPSSVHTFHLVSREECEHAYPGQITQNMLCAGDEKYGKDSWPGVILGGPLVCGDQLPEACVHGGNIPLWIKGEARSLHPRSADTRTGI

SEQ ID NO: 768567 - protein, 275 aa, Homo sapiens
SCSCLPGWLARSLLGTQRSAGSTQRDLRAAVPSPDSRIPGARRPAAGAAMKKLMVVLSLIAAAWAEEQNKLVHGGPCDKTSHPYQAALYTSGHLLCGGVLIHPLWVLTAAHCKKPSLQRSQSSVVRAVIHPDYDAASHDQDIMLLRLAAQPNSLNSSSPFPWRGTAQPTPPAATSWAGARQQMVISLTPSSVHTFHLVSREECEHAYPGQITQNMLCAGDEKYGKDSWPGVILGGPLVCGDQLPEACVHGGNIPLWIKGEARSLHPRSADTRTGI

SEQ ID NO: 768568 - protein, 70 aa, Homo sapiens
FERRTDIPEAEDVYATRHFQAGGDVFLCLTRYIGDSMVRLGLGAGGWLFSTDPILHTKPLNSDLPSHADL

SEQ ID NO: 768569 - protein, 228 aa, Homo sapiens
GSVLVFWMAAEDREMMEARGAGESCPTFPKMVPGDSKSEGKPRAYLEAESQKPDSSYDYLEEMEACEDGGCQGPLKSLSPKSCRATKGQAGDGPKPAELPPTPGTERNPEMELEKVRMEFELTRLKYLHEKNQRQRQHEVVMEQLQRERQHEVVMEQLQQEAAPRLFSGGLQNFLLPQNQFAMFLYCFIFIHIIYVTKEMVFFLFAKHYLFCIAAILLCLIKTFWSYI

SEQ ID NO: 768570 - protein, 108 aa, Homo sapiens
MGTITLSLGEDDDLRSHTGRVRAGLNLDLPGANNGIIISTVFSPPQFSGGLQNFLLPQNQFAMFLYCFIFIHIIYVTKEMVFFLFAKHYLFCIAAILLCLIKTFWSYI

SEQ ID NO: 768571 - protein, 240 aa, Homo sapiens
GSVLVFWMAAEDREMMEARGAGESCPTFPKMVPGDSKSEGKPRAYLEAESQKPDSSYDYLEEMEACEDGGCQGPLKSLSPKSCRATKGQAGDGPKPAELPPTPGTERNPEMELEKVRMEFELTRLKYLHEKNQRQRQHEVVMEQLQRERQHEVVMEQLQRERQHEVVMEQLQQELAPRLFSGGLQNFLLPQNQFAMFLYCFIFIHIIYVTKEMVFFLFAKHYLFCIAAILLCLIKTFWSY

SEQ ID NO: 768572 - protein, 137 aa, Homo sapiens
SGFSFALQGSAADPPGEDPPAHLALLLGHVSPVHLQETSVDAPCLLTLSPAHTELVLRGNLCLCCCLCLERPCPTPSHSCLSVIFPMSVLREPFLATPSKGVLGQVWWPTPVISELWETEVGRSLEARGSRPTWATY

SEQ ID NO: 768573 - protein, 116 aa, Homo sapiens
LYGGDDAQGMMAAMLSHAYGPGGCGAAAAALNGEQAALLRRKSVNTTECVPVPSSEHVAEIVGRQGECRGGEVQLGMAPGVGGETRERSVGRKRRTRRGPQVHREGVWEEPRVDQM

SEQ ID NO: 768574 - protein, 474 aa, Homo sapiens
LYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAANYLDSILNQLTHSRGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 768575 - protein, 434 aa, Homo sapiens
ARITTLPLPSAGTTQLSPSTACHPKGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAANYLDSILNQLTHSRGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 768576 - protein, 373 aa, Homo sapiens
MAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAANYLDSILNQLTHSRGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 768577 - protein, 448 aa, Homo sapiens
ARITTLPLPSAGTTQLSPSTACHPKGCKIKALRAKTNTYIKTPVRGEEPIFWLSNPLGAKGKNGKRNLLCPMGPKKEEGSLSGLQEGHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPFSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 768578 - protein, 474 aa, Homo sapiens; identical to SEQ ID NO: 768574

SEQ ID NO: 768579 - protein, 80 aa, Homo sapiens
WCSRGSRPLFDNGGSTSSSPPESRRKHDCVICFENEVIAALVPCGHNLFCMECANKICEKRTPSCPVCQTAVTQAIQIHS

SEQ ID NO: 768580 - protein, 474 aa, Homo sapiens; identical to SEQ ID NO: 768574

SEQ ID NO: 768581 - protein, 103 aa, Homo sapiens
RPRHMEWFRAAWVPGGQNFRDHAAFLRRRTCPAQPRGAVEDHPGGDIADPWLGAPWGRPASTPTLGNAEPLRMCARGRVCVFLRVSLFRSNLVPGAAGLCMLV

SEQ ID NO: 768582 - protein, 51 aa, Homo sapiens
MQQGHSHQAILGFGHGSHAKHLDKSVRKGGGTCSSAIWKNVEIQGRAESVL

SEQ ID NO: 768583 - protein, 408 aa, Homo sapiens
QEGDVPPSSPWAGAAERAGPAAGAEGRRGTPRPRAGAGPGFQVSSGGCRLSKMRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASRRASGVGAQG

SEQ ID NO: 768584 - protein, 356 aa, Homo sapiens
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASRRASGVGAQG

SEQ ID NO: 768585 - protein, 132 aa, Homo sapiens
QEGDVPPSSPWAGAAERAGPAAGAEGRRGTPRPRAGAGPGFQVSSGGCRLSKMRRFLRPGHDPVRERLKRDLFQFNKTVEHGFPHQPSALGYSPSLRILAIGTRSGAIKLGPGAVAPACNPSAVGGQGGRIA

SEQ ID NO: 768586 - protein, 71 aa, Homo sapiens
TSFSTSSQGRVSESPSLLSVLLPELFSYNTLRTRETQKAVLGEHLASAPPTHSLQSSKSEVPACGEGTGNR

SEQ ID NO: 768587 - protein, 113 aa, Homo sapiens [sequence omitted]

SEQ ID NO: 768588 - protein, 318 aa, Homo sapiens
HLWRRWRLRSAGAAETRRGARPPAAAAPGPCRHPASPRLGRYPASPQRRATALTGPPDASRYPGPQPGRSPAARRPHTSPEPGLGRAAAAARRSQAGLCSVPMAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVNREKGHRLTRAKGNYMGGSSRLWHDGWIKHSPETGPAYHANLDTRELSLTESTWRTKRQRGKGLLKTSLDPPGERSRYP

SEQ ID NO: 768589 - protein, 306 aa, Homo sapiens
HLWRRWRLRSAGAAETRRGARPPAAAAPGPCRHPASPRLGRYPASPQRRATALTGPPDASRYPGPQPGRSPAARRPHTSPEPGLGRAAAAARRSQAGLCSVPMAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768590 - protein, 312 aa, Homo sapiens
TNMYSSSPGCISVLRGCGYAVIDSRPCVLHSHAPGPCRHPASPRLGRYPASPQRRATALTGPPDASRYPGPQPGRSPAARRPHTSPEPGLGRAAAAARRSQAGLCSVPMAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768591 - protein, 306 aa, Homo sapiens; identical to SEQ ID NO: 768589

SEQ ID NO: 768592 - protein, 189 aa, Homo sapiens
PTRRLLIPMVSDEKSAVFLLESYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768593 - protein, 258 aa, Homo sapiens
GGRSWKGGKHRSTLLLWPRPETSGRGWATEPGFTAPRVRAWGWSWSPARCFSSRLRPRLHRRGDSGGNLAAAPRGLRASPRRLSRSCPLQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768594 - protein, 177 aa, Homo sapiens
ANSWCCSLQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768595 - protein, 120 aa, Homo sapiens
RIPGVSFVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768596 - protein, 306 aa, Homo sapiens; identical to SEQ ID NO: 768589

SEQ ID NO: 768597 - protein, 331 aa, Homo sapiens
RQKKKSRGNGPEMRVRVGGAFLGAAPGPCRHPASPRLGRYPASPQRRATALTGPPDASRYPGPQPGRSPAARRPHTSPEPGLGRAAAAARRSQAGLCSVPMAAAGWRDGSGQEKYRLVVVGGGGVGKSALTIQFIQNHLLKKYLHCEKYEYLDALDDIEVKKQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 768598 - protein, 306 aa, Homo sapiens; identical to SEQ ID NO: 768589

SEQ ID NO: 768599 - protein, 1480 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVGVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 768600 - protein, 1466 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVGVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRTRGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 768601 - protein, 331 aa, Homo sapiens
MCGVSLGPWIPSHRLIMHLTPGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 768602 - protein, 1334 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVGVCVDGECHILGRVVRPGPDGVPQSTLLGILLPLLLLVAALATALVFSYWWRRKQLVLPPNLNDLASLDQTAGATPLPILYSGSDYRSGLCHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVVPSDAAMLGGRPSSATHLQSTSGGGGADSVCTAWGPLCAAASNLHELGPQHLA

SEQ ID NO: 768603 - protein, 1321 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVGVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCITAAVLTHARECTPAPATLRASSAHLT

SEQ ID NO: 768604 - protein, 1264 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQEALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWTQQ

SEQ ID NO: 768605 - protein, 83 aa, Homo sapiens
LPAIDGLDSTTCVHGASFSDSEDESCVPLLRKESIQLRDLDSALLAEVKDVLIPHERVVTHSDRVIGKGVGARWGWGRDGVSR

SEQ ID NO: 768606 - protein, 1390 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQEALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 768607 - protein, 401 aa, Homo sapiens
KWRHEKLKPPPVPTSSSFPLPTALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 768608 - protein, 1331 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQEALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVVPSDAAMLGGRPSSATHLQSTSGGGGADSVCTAWGPLCAAASNLHELELTPSCLWAMPGQRAVALHLVPAL

SEQ ID NO: 768609 - protein, 1363 aa, Homo sapiens
RRLGRCCRASAGVRCSDPRAGKGFGFHRNLGRGSAILGLSGPLLKFGPVQTSSRAPSQAHAQVQAQAGRDPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQEALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLALSEQLAPEYSTLSTVR

SEQ ID NO: 768610 - protein, 129 aa, Homo sapiens
TPESPVFHPQVFQVPIRGPGCRHFLTCGRCLRAWHFMGCGWCGNMCGQQKECPGSWQQDHCPPKLTEVWLPWQGTGKSGTGWAWGGGQQVLITIFLRSGGCPSYLQGGHSCQRGCHMQRLGGRKVLECK

SEQ ID NO: 768611 - protein, 194 aa, Homo sapiens
PLTTPLPHAGSPGLLPHRAASASRCAPDPLVPAARGFPSRLPPTLLSCQLFRGGARASRGPPSPLRMPPLLPLASALRQCSSLCLCLPSAPPSSLLALQGFSPRSQAARFLFLFFIFSFFSFLFSSFFPFSLSFSETESRSVAQAGVRWRDLGSMHLPPPEFKGFSCLSLPNTWDYRRPPPCPANFCIFSRDGV

SEQ ID NO: 768612 - protein, 84 aa, Homo sapiens
NSCIPHTNIFLIKRHQALKSQSILTLSHPQQSIHAEKQGPFHTPWHPSTEYRWLCVEAVYYQRYEETLKSGKHWFWPSTATSNS

SEQ ID NO: 768613 - protein, 553 aa, Homo sapiens
RRGGRSRAPKREGDPPRSYGKVGPSSQSFPLWCPRLGRPVPRLLSSFRPSPSTRSLSLSPAAMEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 768614 - protein, 553 aa, Homo sapiens; identical to SEQ ID NO: 768613

SEQ ID NO: 768615 - protein, 197 aa, Homo sapiens [sequence omitted]

SEQ ID NO: 768616 - protein, 505 aa, Homo sapiens
RRGGRSRAPKREGDPPRSYGKVGPSSQSFPLWCPRLGRPVPRLLSSFRPSPSTRSLSLSPAAMEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFVSTF

SEQ ID NO: 768617 - protein, 557 aa, Homo sapiens
RRGGRSRAPKREGDPPRSYGKVGPSSQSFPLWCPRLGRPVPRLLSSFRPSPSTRSLSLSPAAMEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFIEPYWARADFPLPRLWPLASAVIFNRSTNGGQEVTRMVAKGEELSYTPLDGTQRLW

SEQ ID NO: 768618 - protein, 230 aa, Homo sapiens
RRGGRSRAPKREGDPPRSYGKVGPSSQSFPLWCPRLGRPVPRLLSSFRPSPSTRSLSLSPAAMEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTGFLTDTTEGSASCDLRMDLTLFHLGAEFLHYLLLYEADPLSCVFSLLVFSV

SEQ ID NO: 768619 - protein, 443 aa, Homo sapiens
RRGGRSRAPKREGDPPRSYGKVGPSSQSFPLWCPRLGRPVPRLLSSFRPSPSTRSLSSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 768620 - protein, 217 aa, Homo sapiens
CLLALISIASVIRSLNIDDRFGILAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 768621 - protein, 215 aa, Homo sapiens
MSCQKAVLELNIGSQLGPKSPERTEGVTAFEDYGTGLLENQLSVGDFVKIQKAFEFTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALVGNEK

SEQ ID NO: 768622 - protein, 215 aa, Homo sapiens
MDNQGVIYSDLNLPPNPKRQQRKPKGNKSSILATEQEITYAELNLQKASQDFQGNDKTYHCKDLPSAPEKLIVGILGIICLILMASVVTIVVIPSRHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 768623 - protein, 233 aa, Homo sapiens
MDNQGVIYSDLNLPPNPKRQQRKPKGNKSSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 768624 - protein, 215 aa, Homo sapiens; identical to SEQ ID NO: 768622

SEQ ID NO: 768625 - protein, 1174 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDFNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLGGMKKTRVDAKKIGPLKLAALNGLSLSRVPLPDEGKEVATRATNDERCKILEQRLEQGMVFTEYERILKKRLVDGECSTARLPENAERNRFQDVLPYDDARVELVPTKENNTGYINASHIKVSVSGIEWDYIATQGPLQNTCQDFWQMVWEQGIAIIAMVTAEEEGGREKSFRYWPRLGSRHNTVTYGRFKITTRFRTDSGCYATTGLKMKHLLTGQERTVWHLQYTDWPEHGCPEDLKGFLSYLEEIQSVRRHTNSTSDPQSPNPPLLVHCSAGVGRTGVVILSEIMIACLEHNEVLDIPRVLDMLRQQRMMLVQTLCQYTFVYRVLIQFLKSSRLI

SEQ ID NO: 768626 - protein, 1174 aa, Homo sapiens; identical to SEQ ID NO: 768625

SEQ ID NO: 768627 - protein, 1215 aa, Homo sapiens
MPLPFGLKLKRTRRYTVSSKSCLVARIQLLNNEFVEFTLSVESTGQESLEAVAQRLELREGGGLTPSPRLEYSGTVIAQCILKHLGSSDPFALACQELGLQVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDFNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLGGMKKTRVDAKKIGPLKLAALNGLSLSRVPLPDEGKEVATRATNDERCKILEQRLEQGMVFTEYERILKKRLVDGECSTARLPENAERNRFQDVLPYDDARVELVPTKENNTGYINASHIKVSVSGIEWDYIATQGPLQNTCQDFWQMVWEQGIAIIAMVTAEEEGGREKSFRYWPRLGSRHNTVTYGRFKITTRFRTDSGCYATTGLKMKHLLTGQERTVWHLQYTDWPEHGCPEDLKGFLSYLEEIQSVRRHTNSTSDPQSPNPPLLVHCSAGVGRTGVVILSEIMIACLEHNEVLDIPRVLDMLRQQRMMLVQTLCQYTFVYRVLIQFLKSSRLI

SEQ ID NO: 768628 - protein, 1006 aa, Homo sapiens
MPLPFGLKLKRTRRYTVSSKSCLVARIQLLNNEFVEFTLSVESTGQESLEAVAQRLELREVTYFSLWYYNKQNQRRWVDLEKPLKKQLDKYALEPTVYFGVVFYVPSVSQLQQEITRYQYYLQLKKDILEGSIPCTLEQAIQLAGLAVQADFGDFDQYESQDFLQKFALFPVGWLQDEKVLEEATQKVALLHQKYRGLTAPDAEMLYMQEVERMDGYGEESYPAKDSQGSDISIGACLEGIFVKHKNGRHPVVFRWHDIANMSHNKSFFALELANKEETIQFQTEDMETAKYIWRLCVARHKFYRLNQCNLQTQTVTVNPIRRRSSSRMSLPKPQPYVMPPPPQLHYNGHYTEPYASSQDNLFVPNQNGYYCHSQTSLDRAQIDFNGRIRNGSVYSAHSTNSLNNPQPYLQPSPMSSNPSITGSDVMRPDYLPSHRHSAVIPPSYRPTPDYETVMKQLNRGLVHAERQSHSLRNLNIGSSYAYSRPAALVYSQPEIREHAQLPSPAAAHCPFSLSYSFHSPSPYPYPAERRPVVGAVSVPELTNAQLQAQDYPSPNIMRTQVYRPPPPYPPPRPANSTPDLSRHLYISSSNPDLITRRVHHSVQTFQEDSLPVAHSLQEVSEPLTAARHAQLHKRNSIEVAGLSHGLEGLRLKERTLSASAAEVAPRAVSVGSQPSVFTERTQREGPEEAEGLRYGHKKSLSDATMLIHSSEEEEDEDFEEESGARAPPARAREPRPGLAQDPPGCPRVLLAGPLHILEPKAHVPDAEKRMMDSSPVRTTAEAQRPWRDGLLMPSMSESDLTTSGRYRARRDSLKKRPVSDLLSGKKNIVEGLPPLGGMKKTRVDAKKIGPLKLAALNGLSLSRVPLPDEGKEVATRATNDERCKILEQRLEQGMVFTEYERILKKRLVDGECSTARLPENAERNRFQDVLPYDDARVELVPTKENNTGYINASHIKVSVSGIEWDYIATQGPLQNTCQDFWQMVWEQGIAIIAMVTAEEVGTYFS

SEQ ID NO: 768629 - protein, 250 aa, Homo sapiens
LKPEAKLKAKPAGGHRARQDTVGSPTLQRKGVLSLGPTALVPQASGPLRAGRCCTERVSPPQAMVRARFTVPPRASIQLRWSGLGCATRLSGTSAERPIAQDAGNPHDRPQAGGLGGGMAGPLAHQSPVLEKSSKPMPWGLHPAGLSHPLSQRPGCRLSLSSKREGRPAGPYTGASYPQLETRSLLVRGSRGRSTGFRSTLPLPLVPWVTVQKQRLQSLWWNPGSRRRNTGAFEASSRCPIPFRLGLISL

SEQ ID NO: 768630 - protein, 117 aa, Homo sapiens
RKAGAAWARPPCAARAMHRTGRIPQAPCVQGAQEEAWGKETIAIPDLGEVGRGGGEGRSPTLSCPAHCRLRRLPRPSPTCTVAGPLWLTCTAALPRAASSPPTLAVLVPGLMGIRRL

SEQ ID NO: 768631 - protein, 69 aa, Homo sapiens
REFIILLREFIILQFIILPREFIILLRVFIICWVSRVAFSVKGTVEQPAAWWPGLRGLSSCYVLSPSQA

SEQ ID NO: 768632 - protein, 94 aa, Homo sapiens
YRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 768633 - protein, 154 aa, Homo sapiens
CECGPFALRAAGARPQNLLGRGLQGAGRGAERLLFLSCSRATAHAHLTTKLPSSPLAFLATREGPAQGHPATSSCFIVARATRCTRAEMATRSKGVPGEVYSDMDTKLIKDCLVCQREQDPWKRWPSGLPRTTGQAQWLMTIIPELWKAEVGRS

SEQ ID NO: 768634 - protein, 756 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPLETTLGGSMNSVSKLIHYVGWLSTTAMRLESNNTFLLHFILDFYEKVCDIYINYNLPLVVLFPPGIFYSALLSLDTSILNQLCFIMHRYRKNLTAAKKNELVQKTKSEFNFSSKTYQEFNHYLTSMVGCLWTSKPFGKGIYIDPEILEKTGVAEYKNSLNVVHHPSFLSYAVSFLLQESPEERTVNVSSIRGKKWSWYLDYLFSQGLQGLKLFIRSSVHHSSIPRAEGINCNNQY

SEQ ID NO: 768635 - protein, 522 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPL

SEQ ID NO: 768636 - protein, 742 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPLETTLGGSMNSVSKLIHYVGWLSTTAMRLESNNTFLLHFILDFYEKVCDIYINYNLPLVVLFPPGIFYSALLSLDTSILNQLCFIMHRYRKNLTAAKKNELVQKTKSEFNFSSKTYQEFNHYLTSMVGCLWTSKPFGKGIYIDPEILEKTGVAEYKNSLNVVHHPSFLSYAVSFLLQGKKWSWYLDYLFSQGLQGLKLFIRSSVHHSSIPRAEGINCNNQY

SEQ ID NO: 768637 - protein, 88 aa, Homo sapiens
RTKLPLLLQTADRGRRTSGNGPTSDPNPRSPLPQGDPRLGSAEWRPGRLGIRVRRPREQRVNAAFHGSDYRGRALPPPPPRHFSHGTF

SEQ ID NO: 768638 - protein, 120 aa, Homo sapiens
MNLRAGGGSSERGAGSSVAGRPGGSSAAGRQMRGGGQQVPNPRPGFRGPAALEEWPSVSLRAPGPWQGDAGGMLWNMMRKLAGSGKAHSNPFNKQSGETDEQALVRGPDVTPEEALLELP

SEQ ID NO: 768639 - protein, 111 aa, Homo sapiens
MLRSDDDGVYAVMCGSQARIQHHQLFHLIPHQSFPSDPIWRRISHLRNPRVSYCSCMSSGAHALWTHTALCPPTADNVEPGCRSIRLLQASLPPLTVILSRTPQRKIISQL

SEQ ID NO: 768640 - protein, 78 aa, Homo sapiens
MFGRSQQSSQDPAAVKTQYAWWSLFQVQTREPRSELDPDPSLFQAQTREPRPEPDPSLFQAQTREGNHAQSRTRASSR

SEQ ID NO: 768641 - protein, 115 aa, Homo sapiens
PISPLFPSQMCTPANTPATPPNFPDALTMFSRLKASESFHSGGSGTPMAATATSPPPHFPHAATSSSAASSWPTRASPPGAHSTTSHSRPCGLQHPLLRLQTGHPWPPNRPPQNP

SEQ ID NO: 768642 - protein, 70 aa, Homo sapiens
MLFFKNLFPNLYGMANCWGVGLGREGLHERHTHTTPHAQAGPAPASGGQKEVSSPAPPPRGHSVPSWGEG

SEQ ID NO: 768643 - protein, 146 aa, Homo sapiens
VAPGLPGGGKSQAEPYKGLLFCPNTHISLILLLVTLPSSGFLKAKMSNTQAERSIIGMIDMFHKYTRRDDKIDKPSLLTMMKENFPNFLSACDKKGTNYLADVFEKKDKNEDKKIDFSEFLSLLGDIATDYHKQSHGAAPCSGGSQ

SEQ ID NO: 768644 - protein, 126 aa, Homo sapiens
GLGCRPAQTDYWLKDAALGSFLKAKMSNTQAERSIIGMIDMFHKYTRRDDKIDKPSLLTMMKENFPNFLSACDKKGTNYLADVFEKKDKNEDKKIDFSEFLSLLGDIATDYHKQSHGAAPCSGGSQ

SEQ ID NO: 768645 - protein, 85 aa, Homo sapiens
MIDMFHKYTRRDDKIDKPSLLTMMKENFPNFLSACDKKGTNYLADVFEKKDKNEDKKIDFSEFLSLLGDIATAISGTAFRYSHLG

SEQ ID NO: 768646 - protein, 163 aa, Homo sapiens
MARGDQNTADRIKQKETKARAREGTPERRRRREPRANRAKTREQGKKPQRTQTKDSGREGAGATTRERRGGEEEGRRDRQERRRGQEREKEGNEREGRRGDGRRARGGGEGGKEKARREGEENGETGGGGGGGEGKGQGGGGGRRAGGGGGRGGGGGGGGRGG

SEQ ID NO: 768647 - protein, 146 aa, Homo sapiens; identical to SEQ ID NO: 768643

SEQ ID NO: 768648 - protein, 92 aa, Homo sapiens
EPKPQLGTLIFSNITPKSFNMSWTTQAGLFAKIVINVSDAHSLHESQQFTVSGDAKQAHITGLVENTGYDVSVAGTTLAGDPTRPLTAFVIT

SEQ ID NO: 768649 - protein, 124 aa, Homo sapiens
QDYCQSLNVWSYLPWIFFSFGLGFINNLNIISYRITKEEVNLIHLRLQPKIQSNSSFSLSCFFFMFLLLIAARILHRISIEMYEILWSLHVRIAQYVTIQFQREPTFVRFTDQGVVEEVELQIR

SEQ ID NO: 768650 - protein, 56 aa, Homo sapiens
MGLNTVGKYLRGPGRGLHKPLNMKVKEKEAQERLWVGLGPGAVATPVIPALWEAEV

SEQ ID NO: 768651 - protein, 340 aa, Homo sapiens [sequence omitted]

SEQ ID NO: 768652 - protein, 340 aa, Homo sapiens [sequence omitted]

SEQ ID NO: 768653 - protein, 364 aa, Homo sapiens
METKDPSQMFSMLISKVSHPQPGASGSLGPEQPTHQPRQLQVTMDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFALKVEVECSSLQEAVQAAEAGADLVLLDNFKPEVKVGSASGEGSVVGSYLPLACVPQELHPTATVLKAQFPSVAVEASGGITLDNLPQFCGPHIDVISMGMLTQAAPALDFSLKLFAKEVAPVPKIH

SEQ ID NO: 768654 - protein, 129 aa, Homo sapiens [sequence omitted]

SEQ ID NO: 768655 - protein, 93 aa, Homo sapiens
AAVSYHCTTALQPGRQVETLSQKQNKAKTTPKSGFLINPKFMVHPKLFKCQSRLPAPQLQCWALSSPSPSRLPAPQCQVLGPVLTLVLPAAQQ

SEQ ID NO: 768656 - protein, 297 aa, Homo sapiens
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFALKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 768657 - protein, 246 aa, Homo sapiens
VRLGVNRHRGQVTMDAERPGAAAAARHPGSPGGQLAPRGLPRAQLRSLGQRGRPLAGGAVGQIPWGTGRAAFLRCHIYPTQLPSLLVPPRGIEAGAGGQSGRGPGPASHRYDLGGLVMVKDNHVVAAGGVEKAVRAARQAADFALKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 768658 - protein, 223 aa, Homo sapiens
METKDPSQMFSMLISKVSHPQPGASGSLGPEQPTHQPRQLQVTMDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEIQCPKSTSPKPEEDDTGHGLTWLLRTLWVTHL

SEQ ID NO: 768659 - protein, 77 aa, Homo sapiens
GCTLQQGVGSEEALVPYSKPSFPSPGGHSSSGTASSKGSTGPRKTEVLRAGHQRNASDLLDIGYMGSNSQGQFTGEL

SEQ ID NO: 768660 - protein, 1064 aa, Homo sapiens
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNALLYIPDYRLAEGLSNRMP

SEQ ID NO: 768661 - protein, 1379 aa, Homo sapiens
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREGDATHAAGFTWDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 768662 - protein, 289 aa, Homo sapiens
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTGMS

SEQ ID NO: 768663 - protein, 144 aa, Homo sapiens
GQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 768664 - protein, 144 aa, Homo sapiens; identical to SEQ ID NO: 768663

SEQ ID NO: 768665 - protein, 59 aa, Homo sapiens
VRRGAQPESPNSCQQGSKAATIAASLQGLSLPGGDLHPFKSYFSVLGCDSTNTVCSFQN

SEQ ID NO: 768666 - protein, 96 aa, Homo sapiens
MFARHDIVALGQRSRDVPQKCTLHAEPYLLFSTDKKLLLCIRCFRDMQKESRAHCVDLESAYVQGCERLEQAVLVSAGAWRAGPRGGDREPDHALS

SEQ ID NO: 768667 - protein, 115 aa, Homo sapiens
MVEEGLYGSQARPNASGGRARAPLPLWGNPSLGRVNHLRSCPTSTPSRAPLHHAAALRMEPRGTAGPALSTTCLPGGSGNWRRSGEGICPTPPPGLSCGPPGIGTHDPSVLFVFV

SEQ ID NO: 768668 - protein, 173 aa, Homo sapiens
MLVLNLKKIDLSCFAFPLPCFYPPSSCEIFFEKTRLSENIIFAVYFFLTVENGEHCDFTVLRNMLIREHTQDLKDVTNNVHYENYGIRKLAAVTYHGVDNKKNKGQLTKSPLAQMEEERREQVAKIKKMEMEMEQVFEMKVKEKVQKLKDSEAEVQRTFLASEKGLQKKRHRN

SEQ ID NO: 768669 - protein, 113 aa, Homo sapiens
LVPISCLEHTQDLKDVTNNVHYENYGIRKLAAVTYHGVDNKKNKGQLTKSPLAQMEEERREQVAKIKKMEMEMEQVFEMKVKEKVQKLKDSEAEVQRTFLASEKGLQKKRHRN

SEQ ID NO: 768670 - protein, 155 aa, Homo sapiens
KYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 768671 - protein, 210 aa, Homo sapiens
GALLIFALLAAAVASDYWYILEVADAGNGSAWPGRAELLSSHSGLWRICEGQNGCIPLVDPFASESLDVSTSVQHLILLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 768672 - protein, 60 aa, Homo sapiens
SSHPPPSASQSAGITGMSHDTRPVIFFKDCHWVEPTGPSENYGKETHSCKPKPSTLRRTR

SEQ ID NO: 768673 - protein, 109 aa, Homo sapiens
FIDIGHYVRDISAYEELVSKLNLLVEDELKQIAENIESINQNKAPLKYIGNYAILDHLGSGAFGCVYKVRKHSGQNLLAMKEVNLHNPAFGKDKKDRDSSVRNIVSELT

SEQ ID NO: 768674 - protein, 173 aa, Homo sapiens
PDPLFGKVTWTSTAMAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPR

SEQ ID NO: 768675 - protein, 698 aa, Homo sapiens
PDPLFGKVTWTSTAMAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 768676 - protein, 660 aa, Homo sapiens
GSTFRQSDVDVNSNGGRRRCAAAANVERRRLIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 768677 - protein, 713 aa, Homo sapiens
PDPLFGKVTWTSTAMAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 768678 - protein, 202 aa, Homo sapiens
MKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 768679 - protein, 181 aa, Homo sapiens [sequence omitted]

SEQ ID NO: 768680 - protein, 698 aa, Homo sapiens; identical to SEQ ID NO: 768675

SEQ ID NO: 768681 - protein, 662 aa, Homo sapiens
PDPLFGKVTWTSTAMAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKNRNLGNRKVFDSKCGC

SEQ ID NO: 768682 - protein, 235 aa, Homo sapiens
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASATIGAVVVSGCLLLGLAIAGPVLAWRLWRCRVARSRELNKPWAAQDGPKPGLGLQPRYGSRSAPKPQVAVPS

SEQ ID NO: 768683 - protein, 235 aa, Homo sapiens; identical to SEQ ID NO: 768682

SEQ ID NO: 768684 - protein, 235 aa, Homo sapiens; identical to SEQ ID NO: 768682

SEQ ID NO: 768685 - protein, 73 aa, Homo sapiens [sequence omitted]

SEQ ID NO: 768686 - protein, 493 aa, Homo sapiens
MGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSRLSAYPALEGVLHRSSMQPDNSSDSDYDLHGAQRL

SEQ ID NO: 768687 - protein, 493 aa, Homo sapiens; identical to SEQ ID NO: 768686

SEQ ID NO: 768688 - protein, 104 aa, Homo sapiens
GSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 768689 - protein, 104 aa, Homo sapiens; identical to SEQ ID NO: 768688

SEQ ID NO: 768690 - protein, 113 aa, Homo sapiens
GRYGRVIRRRRPPAGRHDPSPRRAGGGGDRRALLHSSCRRRDAQRGRAAWGPPPPPRRTMKLRSKAAALLLLALAALLLALLSLRAGRAEPPALPARPASAPQRHPAPVPARW

SEQ ID NO: 768691 - protein, 49 aa, Homo sapiens
ERRTAPSLDATTVTANSADRHQQCSPQQYPTCPPPWLILPSIAPPTSTP

SEQ ID NO: 768692 - protein, 349 aa, Homo sapiens
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 768693 - protein, 279 aa, Homo sapiens
MQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPAKASTTCASSKSSSFCYCSISSGGWDCCASSITNAWLSSSSTGAGTTLSHLSRISWVLPNAHAHGL

SEQ ID NO: 768694 - protein, 160 aa, Homo sapiens
MQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVLLVEGYR

SEQ ID NO: 768695 - protein, 193 aa, Homo sapiens
MQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKPETWEEAGEKMPSESLCLAAQARLYTRR

SEQ ID NO: 768696 - protein, 183 aa, Homo sapiens
MQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFAGGTLPPSSSKRPNESSEHPPVIDVPPGL

SEQ ID NO: 768697 - protein, 31 aa, Homo sapiens [sequence omitted]

SEQ ID NO: 768698 - protein, 139 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGMWAL

SEQ ID NO: 768699 - protein, 420 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 768700 - protein, 397 aa, Homo sapiens
MTMEKGMSSGEGLPSRSSQVSAGKITAKELETKQSYKEKRGGFVLVHAGAGYHSESKAKEYKHVCKRACQKDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 768701 - protein, 368 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFIMFIVLTPTCRCMVLQKQFFPGISSVRILLTNGRGDLLNLF

SEQ ID NO: 768702 - protein, 129 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEVYTHSYTSWSCIQPSIHVLLVKRQRKSPLPRISTF

SEQ ID NO: 768703 - protein, 318 aa, Homo sapiens
MGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDSSQNKQTLLVEFLWSHTTESMCVGYMSAQDGKAKTHISRLPPGAVAGQSVAIEGGVCRLESPVN

SEQ ID NO: 768704 - protein, 318 aa, Homo sapiens; identical to SEQ ID NO: 768703

SEQ ID NO: 768705 - protein, 132 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELELMWKGQFQVLCVLTNLFLDIIKNPTKTKFKTISNVKVY

SEQ ID NO: 768706 - protein, 64 aa, Homo sapiens
EDTSMVRASPSPSNSAFPRLAPLVLCTVKPLPFNSPVASALIHQVSGMIYVSPHSLSEESFAWV

SEQ ID NO: 768707 - protein, 154 aa, Homo sapiens
RSPSWSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 768708 - protein, 154 aa, Homo sapiens; identical to SEQ ID NO: 768707

SEQ ID NO: 768709 - protein, 154 aa, Homo sapiens; identical to SEQ ID NO: 768707

SEQ ID NO: 768710 - protein, 154 aa, Homo sapiens; identical to SEQ ID NO: 768707

SEQ ID NO: 768711 - protein, 154 aa, Homo sapiens; identical to SEQ ID NO: 768707

SEQ ID NO: 768712 - protein, 154 aa, Homo sapiens; identical to SEQ ID NO: 768707

SEQ ID NO: 768713 - protein, 179 aa, Homo sapiens
MMFLFCLPLKRSCPWSPYIFYVLSLNGLNYIHGFKNYPDESQICIFSIDFTPELLSQISFISIWISHRHFKFHTLKTELIFLPIRRPPPSSHLSRNDSKVCGHLTLSLWSHARAFSLPHRHSPPLPTNAPLFQLANLYSFFKLHIGHHFSRNISPTPNVCVKYSSYVFLQHFLSPSVLL

SEQ ID NO: 768714 - protein, 67 aa, Homo sapiens
FSSQGTSLQMAMDREQNQVLMVASSHRKLVSPPAPPTHVERKLASPSCLSQSVCPHPPVYELVTWPS

SEQ ID NO: 768715 - protein, 321 aa, Homo sapiens
AARPEAQSRSSPTPESRSQEPLDLVLVPDDCRPGTPPSDLIEIQVVKVTDTTLVPEPPEPGSFHCALCPAAFRLVSELLFHEHGHLAGAEGGGQGGDPSRCHVCGHSCPGPASLRAHYSLHTGERPYRCALCPRAFKALAPLLRHQHRHGVEPGTSRRPPDTAAVAEQRPGVAPERAEVVMAAAAAGAAVGKPFACRFCAKPFRRSSDMRDHERVHTGERPYHCGICGKGFTQSSVLSGHARIHTGERPFRCTLCDRTFNNSSNFRKHQRTHFHGPGPGLGDSGGQLGSSAAEGSGSGCGVGDPAEEGRGETAKVKVEADQ

SEQ ID NO: 768716 - protein, 321 aa, Homo sapiens; identical to SEQ ID NO: 768715

SEQ ID NO: 768717 - protein, 321 aa, Homo sapiens; identical to SEQ ID NO: 768715

SEQ ID NO: 768718 - protein, 321 aa, Homo sapiens; identical to SEQ ID NO: 768715

SEQ ID NO: 768719 - protein, 1043 aa, Homo sapiens
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQHKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 768720 - protein, 328 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 768721 - protein, 136 aa, Homo sapiens
METFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 768722 - protein, 266 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVGMCQVLP

SEQ ID NO: 768723 - protein, 199 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGRVEEPSQPSSQEAHP

SEQ ID NO: 768724 - protein, 70 aa, Homo sapiens
PCPHLSPVSPTPILFWVPTSLSVAKALGVKTVGAQALKLFQEHPIFSEVISDQEAVAAIEKFVGMCQVLP

SEQ ID NO: 768725 - protein, 422 aa, Homo sapiens
MDDRKRAKRKSSYREQQPGPPRGRNALWGAADADRRGLGQERRGFTMLAGLKLLSSSDLPTSASRSAGTTSVSHRAQPFERFEAEELCVNGPVGMMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 768726 - protein, 118 aa, Homo sapiens
MAAAYAARQLGVPATIVVPSTTPALTIERLKNEGATVKVVGEVSATQGKEERGRLVAGQGAPCASPPPISPVALQLLDEAFELAKALAKNNPGWVYIPPFDDPLIWYVEVKVTWWGWQ

SEQ ID NO: 768727 - protein, 75 aa, Homo sapiens
DNMYKILVKDYLSRNMTTAYILGDAFYGAVFYEGWCALQGAKDEHLESRKQVLDLGVQDQPDQHGETPSLLKIQN

SEQ ID NO: 768728 - protein, 105 aa, Homo sapiens
AALAPPAMALSDIRVAFSDYQHFALLYLEMRKGGLRNQWLQLYGGRAAGRRPRHPRFGSGMSPLCLHQPFLHAEGGTAGSWCLWPRVPAPPCPSLPLFAPPAPSL

SEQ ID NO: 768729 - protein, 139 aa, Homo sapiens
RKKARSDLFRKNSSHWDHDYSCTHSKGKRDRKKRVYDYESERLDCFQSKHKSASKPHHDDINFYSERKQNRPFFFACVPADSLEVIPKTIRWTIPPETLRKRNFRIPLVAKISSSWNIWSSSKKLLGSLSGSLTTVFHS

SEQ ID NO: 768730 - protein, 128 aa, Homo sapiens
LHSAPTPGPAAAIQSVRCYSHGSQETDEEFDARWVTYFNKPDIDAWELRKGINTLVTYDMVPEPKIIDAALRACRRLNDFASTVRILEVVKDKAGPHKEIYPYVIQELRPTLNELGISTPEELGLDKV

SEQ ID NO: 768731 - protein, 173 aa, Homo sapiens
KYFQPQPATQLGSPPVDPPSSAMMAEEHTDLEAQIVKDIHCKEIDLVNRDPKNINEDIVKVDFEDVIAEPVGTYSFDGVWKVSYTTFTVSKYWCYRLLSTLLGVPLALLWGFLFACISFCHIWAVVPCIKSYLIEIQCISHIYSLCIRTFCNPLFAALGQVCSSIKVVLRKEV

SEQ ID NO: 768732 - protein, 173 aa, Homo sapiens; identical to SEQ ID NO: 768731

SEQ ID NO: 768733 - protein, 73 aa, Homo sapiens
KYFQPQPATQLGSPPVDPPSSAMMAEEHTDLEAQIVKDIHCKEIDLVNRDPKNINEDIVKTGENGKREYPGGI

SEQ ID NO: 768734 - protein, 355 aa, Homo sapiens
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRLTWSFLWSVFWLIQISVCISRVFIATHFPHQVILGVIGGMLVAEAFEHTPGIQTASLGTYLKTNLFLFLFAVGFYLLLRVLNIDLLWSVPIAKKWCANPDWIHIDTTPFAGLVRNLGVLFGLGFAINSEMFLLSCRGGNNYTLSFRLLCALTSLTILQLYHFLQIPTHEEHLFYVLSFCKSASIPLTVVAFIPYSVHMLMKQSGKKSQ

SEQ ID NO: 768735 - protein, 105 aa, Homo sapiens
TVDSNWALDQTDLIDIYRILHPETTECTFFSFAHGTFSKIDHMLSHKISLNKFLKITTILSVFSDHCGIKLEVNIKNSQNHRGTWKLNNLLLKDFCVNNRIKAEI

SEQ ID NO: 768736 - protein, 109 aa, Homo sapiens
DPSPDGRYKTEVECGLEESGFQGRRYLWRKLCYELYTLEAGCLLPIIKPNDEASKDTWAISYVAPALRLLVVWLPTGLFKGQKMLAAAGNEASRRAMLGFACTSKNCWG

SEQ ID NO: 768737 - protein, 160 aa, Homo sapiens
MRTAAGAVSPDSRPETRRQTRKNEEAAWGPRVCRAEREDNRKCPPSILKRSRPEHHRPEAKPQRTSRRVWFREPPAVTVHYIADKNATATVRVPGRPRPHGGSLLLQLCVCVLLVLALGLYCGRAKPVATALEDLRARLLGLVLHLRHVALTCWRGLLRL

SEQ ID NO: 768738 - protein, 138 aa, Homo sapiens
MDTAQAHVSLAVRVGGAGGAVIHKKKQRERQTFLRKSEFKSSSSPQDLSPWFLVLPVIFLVALEKITWGLHINPIINSKLLVLSRESQFKFTLAPLGSPEQILHQKVSKGLVYTTFKVKPINNGSTDPNAYPLIGEKS

SEQ ID NO: 768739 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 768740 - protein, 108 aa, Homo sapiens; identical to SEQ ID NO: 768739

SEQ ID NO: 768741 - protein, 127 aa, Homo sapiens
MRPLDIDEVEAPEEVEVLEPEEDFEQFLLPVINEMREDIASLIREHGRAYLRTRSKLWEMDNMLIQIKTQVEASEESALNHVQHPSGEADERVSELCEKAEEKAKEIAKMAEMLVELVWRIERSESS

SEQ ID NO: 768742 - protein, 127 aa, Homo sapiens; identical to SEQ ID NO: 768741

SEQ ID NO: 768743 - protein, 127 aa, Homo sapiens; identical to SEQ ID NO: 768741

SEQ ID NO: 768744 - protein, 102 aa, Homo sapiens
MRPLDIDEVEAPEEVEVLEPEEDFEQFLLPVINEMREDIASLIREHGRAYLRTRSKLWEMDNMLIQIMAKPTRECRSCARRLRRKPRRLRRWQRCWSSSSGE

SEQ ID NO: 768745 - protein, 77 aa, Homo sapiens
QKDPDDQKGREWTFAQIKTQVEASEESALNHVQHPSGEADERVSELCEKAEEKAKEIAKMAEMLVELVWRIERSESS

SEQ ID NO: 768746 - protein, 150 aa, Homo sapiens
DQRPGGPAAQQGLPSWVRLAGACGDLGGYSQGSVLPRATPAHLPWNRTRGFCLGEYLGTCLLCCPGHIPAAAHRGGTAWAQGQGPLCGDTRPGGDNASSELPPTPGLLQPGLSWGREGLSFLSTVGGRQGLRLKRPQHGAPGEKAPHLRE

SEQ ID NO: 768747 - protein, 105 aa, Homo sapiens
GRESGLHSIPSALQVVGEGGRSILRTGWHHHISPYIQELCKPTIALPAEHSRDPFASIHHQTVLERLSATAPNWKQPISIKFIQQGGQISNGIFICGILRSSENA

SEQ ID NO: 768748 - protein, 87 aa, Homo sapiens
LGEEIKIKITNMTFQYRKLKCMTDSESAPPDWPYYLAIDGILAKVPESCDGKLPDSQPPGPSTSQTEASLSPPAKSTPLYFPYNQCS

SEQ ID NO: 768749 - protein, 863 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 768750 - protein, 753 aa, Homo sapiens
MNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 768751 - protein, 365 aa, Homo sapiens
FREPIFRLQGKLYELSSVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 768752 - protein, 815 aa, Homo sapiens
CILLLFSFYRWNTLKHEKSLYLEIIFENNPITNSELLKNNKEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPRRPPPAVPGRPS

SEQ ID NO: 768753 - protein, 804 aa, Homo sapiens
CILLLFSFYRWNTLKHEKSLYLEIIFENNPITNSELLKNNKEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPR

SEQ ID NO: 768754 - protein, 454 aa, Homo sapiens
VEVLIVEPWLPGGRSRTVVDGGVAVAPDSARRGRSCFAIRVGLPRQWRHESWAPYAAVPSLGKRRLLQRTDRRVPYRVDLQGSGMEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 768755 - protein, 429 aa, Homo sapiens
LPAHSAAASGLASAEKILFYPALHLCSTASRLRAGVSTVVPAPKEVAEVPYRVDLQGSGMEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 768756 - protein, 1274 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDVWVRSRPCARDAHRKEICSVAIISGGQGYRNFGSALGSSGRQAPCGETDSTLLIWQVPLML

SEQ ID NO: 768757 - protein, 1298 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPDRSLIKCSPEPELFKVVYLQIDGLGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDVWVRSRPCARDAHRKEICSVAIISGGQGYRNFGSALGSSGRQAPCGETDSTLLIWQVPLML

SEQ ID NO: 768758 - protein, 1259 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPDRSLIKVLQEPELFKVVYLQIDGLGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDVWVRSRPCARDAHRKEICSVAIISGGQGYRNFGSALGSSGRQAPCGETDSTLLIWQVPLML

SEQ ID NO: 768759 - protein, 1268 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITVNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDVWVRSRPCARDAHRKEICSVAIISGGQGYRNFGSALGSSGRQAPCGETDSTLLIWQVPLML

SEQ ID NO: 768760 - protein, 1274 aa, Homo sapiens; identical to SEQ ID NO: 768756

SEQ ID NO: 768761 - protein, 270 aa, Homo sapiens
SSWRLAQRRALGAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDVWVRSRPCARDAHRKEICSVAIISGGQGYRNFGSALGSSGRQAPCGETDSTLLIWQVPLML

SEQ ID NO: 768762 - protein, 1072 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPALVLKKFFSECFGEEF

SEQ ID NO: 768763 - protein, 81 aa, Homo sapiens
LRIPNPATDGSIYEMADDPDVWVRSRPCARDAHRKEICSVAIISGGQGYRNFGSALGSSGRQAPCGETDSTLLIWQVPLML

SEQ ID NO: 768764 - protein, 896 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSTNDAANYGGISRVT

SEQ ID NO: 768765 - protein, 568 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKVSWASHLPALTCLPSPVLLPVPLPHATHTRWQCSLREGRP

SEQ ID NO: 768766 - protein, 157 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGALRPMGKHSPCF

SEQ ID NO: 768767 - protein, 39 aa, Homo sapiens
MTVAQDWCLALQRLMRVKEEEIHSANKCRLRLLLPGKPD

SEQ ID NO: 768768 - protein, 122 aa, Homo sapiens [sequence omitted]

SEQ ID NO: 768769 - protein, 109 aa, Homo sapiens
ILNNEPWKATSTDSQLKLIHHLWIKQFLKTLSALKIKILAFESGSSLCTSNLGSGVLPKPVQARHKCLTSPRGFRSTMSSRGEPWSQAQSHLTSPKAWEVGGVIAPFYR

SEQ ID NO: 768770 - protein, 109 aa, Homo sapiens; identical to SEQ ID NO: 768769

SEQ ID NO: 768771 - protein, 109 aa, Homo sapiens; identical to SEQ ID NO: 768769

SEQ ID NO: 768772 - protein, 361 aa, Homo sapiens
ENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSI

SEQ ID NO: 768773 - protein, 227 aa, Homo sapiens
LHRLGDAMFQGQRGWFCGSVSQDLRQFWVAEGGTISDPRAADFLFSCDASHPDTLRIYQSLDYIEDNATVFHAYYLSAVANAKIKNSVALGHFILPPACLQKEIRRKIGSFIWEQDQHFLIEKHDEVTPNEIKTLRENSELATEHKKELSKSPEKHFIRTPVVEKQMYFPLQNYPVNNMVTGYISIDAMKKFLGELHDFIPGTSGYLAYHVQNEINMSAIKNKLKRK

SEQ ID NO: 768774 - protein, 223 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 768775 - protein, 249 aa, Homo sapiens
MNLDALRIHHYVTKTALVCGTRSGSLKQKSHDRRSGAINRTVLSQAMVVPICRRENTDELAVHSSQLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 768776 - protein, 143 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLAGTGFLWGQV

SEQ ID NO: 768777 - protein, 114 aa, Homo sapiens
MNKPLLWISSSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 768778 - protein, 223 aa, Homo sapiens; identical to SEQ ID NO: 768774

SEQ ID NO: 768779 - protein, 167 aa, Homo sapiens
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLLGICTCGTLCCPQKISCLPIRVPLSLPISWTGRL

SEQ ID NO: 768780 - protein, 79 aa, Homo sapiens
GTTFGRHLVKNIRLEQPCSCKAGQKKCTCHRPGKKETWLFSRFSTGWSCGLHADWTELTNCVPAIMEKKDCPRNHSHTR

SEQ ID NO: 768781 - protein, 249 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 768782 - protein, 204 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYNAFMGCTRFEI

SEQ ID NO: 768783 - protein, 69 aa, Homo sapiens
RAPPGNRYLEFFGEDLTAKDIEEIIDELKAGKIPKPGPRSGRFSCEPAGGLTSLTEPPKGPGFGVQAGL

SEQ ID NO: 768784 - protein, 107 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVLDSFLP

SEQ ID NO: 768785 - protein, 252 aa, Homo sapiens [sequence omitted]

SEQ ID NO: 768786 - protein, 220 aa, Homo sapiens
MQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 768787 - protein, 220 aa, Homo sapiens; identical to SEQ ID NO: 768786

SEQ ID NO: 768788 - protein, 249 aa, Homo sapiens; identical to SEQ ID NO: 768781

SEQ ID NO: 768789 - protein, 249 aa, Homo sapiens; identical to SEQ ID NO: 768781

SEQ ID NO: 768790 - protein, 249 aa, Homo sapiens; identical to SEQ ID NO: 768781

SEQ ID NO: 768791 - protein, 233 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLEVECLGACVNAPMVQINDNYYEDLTAKDIEEIIDELKAGKIPKPGPRSGRFSCEPAGGLTSLTEPPKGPGFGVQAGL

SEQ ID NO: 768792 - protein, 249 aa, Homo sapiens; identical to SEQ ID NO: 768781

SEQ ID NO: 768793 - protein, 195 aa, Homo sapiens
DPRVADARIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 768794 - protein, 81 aa, Homo sapiens
VPSGSPRPGVGSAHAVRPGRARDSRLARLGKVNSVARHVLLRGAPGPGGWPHRPLAQNLGLLWPDQFRRPSLRRRHLSFQA

SEQ ID NO: 768795 - protein, 220 aa, Homo sapiens; identical to SEQ ID NO: 768786

SEQ ID NO: 768796 - protein, 249 aa, Homo sapiens; identical to SEQ ID NO: 768781

SEQ ID NO: 768797 - protein, 233 aa, Homo sapiens
VTLLCCTFEQELLLITLHIFLENLKFRRECITADTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 768798 - protein, 249 aa, Homo sapiens; identical to SEQ ID NO: 768781

SEQ ID NO: 768799 - protein, 157 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLG

SEQ ID NO: 768800 - protein, 116 aa, Homo sapiens
MHLPAFSSVYSGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 768801 - protein, 214 aa, Homo sapiens
LERNTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 768802 - protein, 139 aa, Homo sapiens
MCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 768803 - protein, 502 aa, Homo sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNTTPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIQVSEPDAAGPCPAARVPNPTGGHGTALWSLTGRAPGAQFWRGQWPFGEAAGHLRPGCVCCWGEARKWAARMMDEEAVVDRGKGRDA

SEQ ID NO: 768804 - protein, 393 aa, Homo sapiens
IYQHTSSRYVRELELRMQHYDLTIPVTPDLAQEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIQVSEPDAAGPCPAARVPNPTGGHGTALWSLTGRAPGAQFWRGQWPFGEAAGHLRPGCVCCWGEARKWAARMMDEEAVVDRGKGRDA

SEQ ID NO: 768805 - protein, 150 aa, Homo sapiens
MATDVQLADYPLMSPKAELKLEKKSGRKPRSPRDSGPQKELVIPGIVDFERIRRALRTPKPQTPGTYCFGRLSHHSFFSRHHPHPQHVTHIQASNPLQISPGSLSVSSGIFQPPCLSQLSFPAVKWGYPPSLSPLETHSLIGTPSFLLVG

SEQ ID NO: 768806 - protein, 98 aa, Homo sapiens
IRIGRTWRFPVDTGSVSLDRFLVSLEGSWPLLTEHPLWVSVVQAVHIHCVYAMTVRLLVEGAGSPLQSLRMGLHDWFRPTCWGAHSLSTKGIFILPDL

SEQ ID NO: 768807 - protein, 72 aa, Homo sapiens
VMRRGRPEREGVGVSCRRSFCQAGGTSGPPALTSRLLFMFENEIGGLGGRQFPVADRRKHHSWAFKQREFTH

SEQ ID NO: 768808 - protein, 113 aa, Homo sapiens
DVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGM

SEQ ID NO: 768809 - protein, 995 aa, Homo sapiens
MDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 768810 - protein, 82 aa, Homo sapiens
ACSEGALPSLGVTISPIPRPVPLSGLVLVAALSSVLGYVPVWMLHSSLREAWHPLPNVSQRKAEYLVPRRRYWVGKRWGKAV

SEQ ID NO: 768811 - protein, 1167 aa, Homo sapiens
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 768812 - protein, 1009 aa, Homo sapiens
MDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLDPQVAGAGIAGRTGCT

SEQ ID NO: 768813 - protein, 62 aa, Homo sapiens
MLLRGGRRLFLSGAPRFRHRGKVIAFQLKKDGAVRVAQSLQGEQVGHPRKGGTFGFPGTSGL

SEQ ID NO: 768814 - protein, 117 aa, Homo sapiens
MIKHAQLHLELDLSLGLKTLAENLMCAWPSKAHLSLAWNSDQSPGGVFPDLLWGEPLGSDDKDPELAESCASSSPCLWVDRTRLGKERCLAMKGWLAKVEAQPAPAQAPSSRLSSHS

SEQ ID NO: 768815 - protein, 171 aa, Homo sapiens
LRHPLWPVRGLPSLRGGQTQGSKVPPPHPRGVDRRGRLGGQLLQAIVFAGGGGVGARAQRGPGSLELRKWHRSRARGLSKDLFWALGVLAVTVGLGGSRLQPLPQFRTLAGGLRLTSEKGQEGVNPQPHRGREDFSRSPPLGRGPLAAVPEGRKRCVTVGRVLNLSEPKWL

SEQ ID NO: 768816 - protein, 103 aa, Homo sapiens
HSHKVKEQFPKPLRGRVKTCDVGSLETPGPRVLQMWGAWKHPAHACCRCGEPGNTRPTRAADVGSLETPGPRVLQMWGARKHLAHACSVRHGVWFMVADTKSH

SEQ ID NO: 768817 - protein, 101 aa, Homo sapiens
HSHKVKEQFPKPLRGRVKTCDVGSLETPGPRVLQMWGAWKHPAHACCRCGEPGNTRPTRAADVGSLETPGPRVLQMWGARKHLAHACCREPGNTWAHACFS

SEQ ID NO: 768818 - protein, 107 aa, Homo sapiens
WAGTGGVALRTSRFPLTQSAPQSSRKAFGVGDGCDACRAPRPRDLHLAGVRTGAGEPRMRTGESLPGRRCSLRSPGLGARFFAGSPVIHCGSSAAPPLLVPVIPAAQ

SEQ ID NO: 768819 - protein, 73 aa, Homo sapiens
KTQKGGGVFQPRLERSGTISAHCSLDLWGSRDPHASASYVAGATDMHHHTWLEAILVLRLSSSGAGSSTVLCL

SEQ ID NO: 768820 - protein, 802 aa, Homo sapiens
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVVSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 768821 - protein, 751 aa, Homo sapiens [sequence omitted]

SEQ ID NO: 768822 - protein, 715 aa, Homo sapiens [sequence omitted]

SEQ ID NO: 768823 - protein, 637 aa, Homo sapiens
MGVIGLILPPTFSFLEMMWRICPALAVGCTVVALVPPASPAPLLLAQLAGELGPFPGILNVVSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 768824 - protein, 682 aa, Homo sapiens
NWLERPGVIGRGEVRDGDVQLAQQLLHYHAIQASTQEEALAGWEPMGVIGLILPPTFSFLEMMWRICPALAVGCTVVALVPPASPAPLLLAQLAGELGPFPGILNVVSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 768825 - protein, 802 aa, Homo sapiens; identical to SEQ ID NO: 768820

SEQ ID NO: 768826 - protein, 613 aa, Homo sapiens
MAVGCTVVALVPPASPAPLLLAQLAGELGPFPGILNVVSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 768827 - protein, 802 aa, Homo sapiens; identical to SEQ ID NO: 768820

SEQ ID NO: 768828 - protein, 667 aa, Homo sapiens
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGGFGVAEELDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 768829 - protein, 276 aa, Homo sapiens
MAAGPARDWPARRGLKRSAREPGAYCGTALESTRVRELPGGAMSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 768830 - protein, 276 aa, Homo sapiens; identical to SEQ ID NO: 768829

SEQ ID NO: 768831 - protein, 276 aa, Homo sapiens; identical to SEQ ID NO: 768829

SEQ ID NO: 768832 - protein, 129 aa, Homo sapiens
LQEEVGSGWAACRQRPVGGSGRKATPGGSREAWRVTTPWPSGNSPLCGCPTCRMLPPLLPTGLLKASLSAAGTIAQAGAGPAWWPGIWHTPSPWGEGQSPTLLTSACFFPSAAFTAEFLFSLGSLCQHL

SEQ ID NO: 768833 - protein, 234 aa, Homo sapiens
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 768834 - protein, 276 aa, Homo sapiens; identical to SEQ ID NO: 768829

SEQ ID NO: 768835 - protein, 276 aa, Homo sapiens; identical to SEQ ID NO: 768829

SEQ ID NO: 768836 - protein, 276 aa, Homo sapiens; identical to SEQ ID NO: 768829

SEQ ID NO: 768837 - protein, 276 aa, Homo sapiens; identical to SEQ ID NO: 768829

SEQ ID NO: 768838 - protein, 276 aa, Homo sapiens; identical to SEQ ID NO: 768829

SEQ ID NO: 768839 - protein, 276 aa, Homo sapiens; identical to SEQ ID NO: 768829

SEQ ID NO: 768840 - protein, 276 aa, Homo sapiens; identical to SEQ ID NO: 768829

SEQ ID NO: 768841 - protein, 234 aa, Homo sapiens; identical to SEQ ID NO: 768833

SEQ ID NO: 768842 - protein, 284 aa, Homo sapiens
MAAGPARDWPARRGLKRSAREPGAYCGTALESTRVRELPGGAMSCINLPTVLPGSPSKTRGQIQVILGPMFSGKSTELMRRVRRFQIAQYKCLVIKYAKDTRYSSSFCTHDRTRSRIIARNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 768843 - protein, 309 aa, Homo sapiens
MAAGPARDWPARRGLKRSAREPGAYCGTALESTRVRELPGGAMSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVAPPAFPAGRRGGGMALPPSCPGPSPIPCPCGQVEVIGGADKYHSVCRLCYFKKASGQPAGPDNKENCPVPGKPGEAVAARKLFAPQQILQCSPAN

SEQ ID NO: 768844 - protein, 156 aa, Homo sapiens
MANAGKTVIVAALDGTFQRKPFGAILNLVPLAESVVKLTAVCMECFREAAYTKRLGTEKEVAPPAFPAGRRGGGMALPPSCPGPSPIPCPCGQVEVIGGADKYHSVCRLCYFKKASGQPAGPDNKENCPVPGKPGEAVAARKLFAPQQILQCSPAN

SEQ ID NO: 768845 - protein, 222 aa, Homo sapiens
MAAGPARDWPARRGLKRSAREPGAYCGTALESTRVRELPGGAMSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEQILQCSPAN

SEQ ID NO: 768846 - protein, 79 aa, Homo sapiens
SSRPATNLSVHYALTLYSRKLHSRLRTAIPRAPLVAPVRTLLGPISLDGGDHTLAFWELSFVWLPHLPHAPSSPTHWSA

SEQ ID NO: 768847 - protein, 253 aa, Homo sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 768848 - protein, 253 aa, Homo sapiens; identical to SEQ ID NO: 768847

SEQ ID NO: 768849 - protein, 69 aa, Homo sapiens
LALEAPPIGLLTKKNACNGDSGGPLVCRGTLQGLVSWGTFPCGQPNDPGVYTQVCKFTKWINDTMKKHR

SEQ ID NO: 768850 - protein, 190 aa, Homo sapiens
MSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGNAAAAGSLRRTLCGGPGRQVPKAAPLAWAWGLRRMILCFCLSLPCPFKSA

SEQ ID NO: 768851 - protein, 639 aa, Homo sapiens
AASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 768852 - protein, 629 aa, Homo sapiens
AASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVHDRYREAKPTGLEVLGLSESSGRGGPPRCQVGPGATQRCDERHTPTLSTDAPFKKTEKPGVNTGVHPGVSSREAGHLRRTDDTLNTHTMSLDM

SEQ ID NO: 768853 - protein, 321 aa, Homo sapiens
AASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSR

SEQ ID NO: 768854 - protein, 274 aa, Homo sapiens
MGFSSSKPIFSQCRPHFPHLSDLLPRRRGNRLSRWPSVVLTWFLSRRPGGETHHCVCHNPRGWWSHPDGGQPDGPRGPRTHGHHPAARHTRDPRAAPPSSPGRDPERKACGSHEQFSRQRLRPHQPFAAPCDPSEFIRAGGGHPGVRGGAQGASSSRRGHGHHHPSHCHHRLCLRLFHWRARGQKVPGGGAQWGCNHTGWSDRSCRPPGARHRGVRSPATRGSGTHPAATPKLDPAAQAAAPTDGGEQPAAACGHRRHLDTPSPFHLIACLPVV

SEQ ID NO: 768855 - protein, 208 aa, Homo sapiens
AASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKV

SEQ ID NO: 768856 - protein, 34 aa, Homo sapiens
MTFSRNCTSSANTISFSLLVQYSINYMRYSTLYF

SEQ ID NO: 768857 - protein, 34 aa, Homo sapiens; identical to SEQ ID NO: 768856

SEQ ID NO: 768858 - protein, 87 aa, Homo sapiens
VSVASGVKPQTFVASVTAHEGSANPQVCSSRIFCEEPRNKASTPSEGTQAGCRCGLGWPAFIPLFGPTHILLIGPFYRMLIGPFTEC

SEQ ID NO: 768859 - protein, 109 aa, Homo sapiens
MNPALGNQTDVAGLFLANSSEALERAVRCCTQASVVTDDGFAEGGPDERSLYIMRVVQIAVMCVLSLTVVFGIFFLGCNLLIKSEGMINFLVKDRRPSKEVEAVVVGPY

SEQ ID NO: 768860 - protein, 109 aa, Homo sapiens; identical to SEQ ID NO: 768859

SEQ ID NO: 768861 - protein, 109 aa, Homo sapiens; identical to SEQ ID NO: 768859

SEQ ID NO: 768862 - protein, 251 aa, Homo sapiens
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 768863 - protein, 251 aa, Homo sapiens; identical to SEQ ID NO: 768862

SEQ ID NO: 768864 - protein, 118 aa, Homo sapiens
MPALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 768865 - protein, 130 aa, Homo sapiens
MPALERGLTKALKKLDDYLNTPLPEEIDANTCGEDKGSRRKFLDGDELTLADCNLLPKLHVVKTHLLTSSSNFLKIVAKKYRNYDIPAEMTGLWRYLKNAYARDEFTNTCAADSEIELAYADVAKRLSRS

SEQ ID NO: 768866 - protein, 410 aa, Homo sapiens
MNDEDYSTIYDTIQNERTYEVPDQPEENESPHYDDVHEYLRPENDLYATQLNTHEYDFVSVYTIKGEETSLASVQSEDRGYLLPDEIYSELQEAHPGEPQEDRGISMEGLYSSTQDQQLCAAELQENGSVMKEDLPSPSSFTIQHSKAFSTTKYSCYSDAEGLEEKEGAHMNPEIYLFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 768867 - protein, 410 aa, Homo sapiens; identical to SEQ ID NO: 768866

SEQ ID NO: 768868 - protein, 249 aa, Homo sapiens [sequence omitted]

SEQ ID NO: 768869 - protein, 410 aa, Homo sapiens; identical to SEQ ID NO: 768866

SEQ ID NO: 768870 - protein, 233 aa, Homo sapiens
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIIKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 768871 - protein, 79 aa, Homo sapiens
MRGMLHPYGQPGVATPLLLMETREGRGQKALPKVSQPGACLHWSLCGQCCPGAAAVHWRVSCMEEPEEMVPRTELAALY

SEQ ID NO: 768872 - protein, 203 aa, Homo sapiens
GRRLCLGEPGLAGGDFLVRIEPAKRQNRKRPGAKATGVCGRDLSAESGPRFPGERRGPRAGARAALGLYFAARGRGDRPRTRGDEGTRGPCPVREAEGLEGLPGAGAGAPLPGRRLAPDTRQREAARAQQGFSPAPVPASPAASVRGPCPVLCRERCLSARDVDSFPLLLAWLLLTQVVRTPLGCHPCRKPPLVKGPRHPPHM

SEQ ID NO: 768873 - protein, 678 aa, Homo sapiens
MELRSYQWEVIMPALEGKNIIIWLPTGAGKTRAAAYVAKRHLETVDGAKVVVLVNRVHLVTQHGEEFRRMLDGRWTVTTLSGDMGPRAGFGHLARCHDLLICTAELLQMALTSPEEEEHVELTVFSLIVVDECHHTHKDTVYNVIMSQYLELKLQRAQPLPQVLGLTASPGTGGASKLDGAINHVLQLCANLDTWCIMSPQNCCPQLQEHSQQPCKQYNLCHRRSQDPFGDLLKKLMDQIHDHLEMPELSRKFGTQMYEQQVVKLSEAAALAGLQEQRVYALHLRRYNDALLIHDTVRAVDALAALQDFYHREHVTKTQILCAERRLLALFDDRKNELAHLATHGPENPKLEMLEKILQRQFSSSNSPRGIIFTRTRQSAHSLLLWLQQQQGLQTVDIRAQLLIGAGNSSQSTHMTQRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKIRDLQQAALTKRAAQAAQRENQRQQFPVEHVQLLCINCMVAVGHGSDLRKVEGTHHVNVNPNFSNYYNVSRDPVVINKVFKDWKPGGVISCRNCGEVWGLQMIYKSVKLPVLKVRSMLLETPQGRIQAKKWSRVPFSVPDFDFLQHCAENLSDLSLD

SEQ ID NO: 768874 - protein, 678 aa, Homo sapiens; identical to SEQ ID NO: 768873

SEQ ID NO: 768875 - protein, 299 aa, Homo sapiens
MTRCSSMTPSAPWMPWLRCRISITGSTSLKPRSCVPSAGCWPCSMRDQQEVIQKFQDGTLNLLVATSVAEEGLDIPHCNVVVRYGLLTNEISMVQARGRARADQSVYAFVATEGSRELKRELINEALETLMEQAVAAVQKMDQAEYQAKIRDLQQAALTKRAAQAAQRENQRQQFPVEHVQLLCINCMVAVGHGSDLRKVEGTHHVNVNPNFSDPVVINKVFKDWKPGGVISCRNCGEVWGLQMIYKSVKLPVLKVRSMLLETPQGRIQAKKWSRVPFSVPDFDFLQHCAENLSDLSLD

SEQ ID NO: 768876 - protein, 177 aa, Homo sapiens
GQGAGLWAAQTLRPIPAAALAGLQEQRVYALHLRRYNDALLIHDTVRAVDALAALQDFYHREHVTKTQILCAERRLLALFDDRKNELAHLATHGPSPCLTLTSCSIVPRTCRTSPWTDHLIAAVPGLGCRGRESLQQTPGPSFLNHQLWASGPPATQESWAPWLRLPQWENNRRARA

SEQ ID NO: 768877 - protein, 678 aa, Homo sapiens; identical to SEQ ID NO: 768873

SEQ ID NO: 768878 - protein, 71 aa, Homo sapiens
MSQYLELKLQRAQPLPQVLGLTASPGTGGASKLDGAINHVLQVSLAPVGLPLPDPPGTSLPPCLPCHYPVP

SEQ ID NO: 768879 - protein, 1218 aa, Homo sapiens
GTRPRRGGCRSGLPAPRRRCTPDPAAVPRAMDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 768880 - protein, 1218 aa, Homo sapiens; identical to SEQ ID NO: 768879

SEQ ID NO: 768881 - protein, 386 aa, Homo sapiens
MEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 768882 - protein, 934 aa, Homo sapiens
GTRPRRGGCRSGLPAPRRRCTPDPAAVPRAMDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRRGVYQAMISLALKCIII

SEQ ID NO: 768883 - protein, 851 aa, Homo sapiens
GTRPRRGGCRSGLPAPRRRCTPDPAAVPRAMDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQKGAEEAYPAALIGR

SEQ ID NO: 768884 - protein, 125 aa, Homo sapiens
MSSVVETELVYIEGEGLRVPTQLPTPGSPWPRCPSGTAAMRMSTVSLTLCWMPGVTCPRPCELAPSTPTLAPSPSLPEALGLLGPWIISWTSSSQAAWIKHCTWSLRSSPGSATNSCITSGKSLL

SEQ ID NO: 768885 - protein, 1218 aa, Homo sapiens; identical to SEQ ID NO: 768879

SEQ ID NO: 768886 - protein, 1218 aa, Homo sapiens; identical to SEQ ID NO: 768879

SEQ ID NO: 768887 - protein, 1086 aa, Homo sapiens
MRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 768888 - protein, 1219 aa, Homo sapiens
GTRPRRGGCRSGLPAPRRRCTPDPAAVPRAMDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKVRALAGEGRSSILAGRNGSLTLYQ

SEQ ID NO: 768889 - protein, 390 aa, Homo sapiens
GTRPRRGGCRSGLPAPRRRCTPDPAAVPRAMDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFSGFDEEVLNLHPGVDAVGAIQDNDDVMYGLAPLESWGHGLGDLKIGV

SEQ ID NO: 768890 - protein, 131 aa, Homo sapiens
MRHRDSLEALSSLGPSVRSRTAHLLPDRLVLGNASSLPLVATLPHRQCHIPVNTNPLGLSGCATVTGSLGCHFTSWRLLWPVAALPEFCLGPLGSFHPLGLAGCACLSLLVQIPCLPRASQVQSSKGCMSK

SEQ ID NO: 768891 - protein, 161 aa, Homo sapiens
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDEFLEFMKGVE

SEQ ID NO: 768892 - protein, 115 aa, Homo sapiens
MLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDEFLEFMKGVE

SEQ ID NO: 768893 - protein, 161 aa, Homo sapiens; identical to SEQ ID NO: 768891

SEQ ID NO: 768894 - protein, 132 aa, Homo sapiens
MDDIYKAAVEQLTEEQKNEFKAAFDIFVLGAEDGCISTKELGKVMRMLGQNPTPEELQEMIDEVDEDELPRSHHQSRADSEEQRDSVKFQNWPDSSHYMIKKKTSGFVVKKIGFMVSIIVNFSSMFQLSPDF

SEQ ID NO: 768895 - protein, 161 aa, Homo sapiens; identical to SEQ ID NO: 768891

SEQ ID NO: 768896 - protein, 30 aa, Homo sapiens
MGDFPDPGGVEERRLFDVVQGQSVEGEWFR

SEQ ID NO: 768897 - protein, 177 aa, Homo sapiens
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDELMELMKVLEEGLILVTDATDARRLT

SEQ ID NO: 768898 - protein, 91 aa, Homo sapiens
KGGDQEVGLLITTIEDRIVLEIDRLEDHGVAEAIPTMIDQTAAGIPSTVLLTTLQERSESGKRTKEGQFKRPKGGWKVLQYEYCTNILTLV

SEQ ID NO: 768899 - protein, 154 aa, Homo sapiens
MSKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNSSPNTRTQKARHCGHCPEEWITYSNSCYYIGKKEELGKRVCWPVLRRTPVCFL

SEQ ID NO: 768900 - protein, 154 aa, Homo sapiens; identical to SEQ ID NO: 768899

SEQ ID NO: 768901 - protein, 128 aa, Homo sapiens
PEADETPEVRLGELTAHSREASVDAGSHCQSRTRLRDFCLLKWTSAVLGECLYSFPYTTVGMVQLHIDRKPRETLDVRVPASPSGSFGTWPPQSSSTRSRDCQALPLIHHHKNVTCYGSLLAIKGYTL

SEQ ID NO: 768902 - protein, 105 aa, Homo sapiens
VTIRKHENSVECWNPDTNTWTSLERMNESRSTLGVVVLAGELYALGGYDGQSYLQSVEKYIPKIRKWQPVAPMTTTRSCFAAAVLDGMIYAIGGYGPAHMNRYLT

SEQ ID NO: 768903 - protein, 225 aa, Homo sapiens
VTIRKHENSVECWNPDTNTWTSLERMNESRSTLGVVVLAGELYALGGYDGQSYLQSVEKYIPKIRKWQPVAPMTTTRSCFAAAVLDGMIYAIGGYGPAHMNSVERYDPSKDSWEMVASMADKRIHFGVGVMLGFIFVVGGHNGVSHLSSIERYDPHQNQWTVCRPMKEPRTGVGAAVIDNYLYVVGGHSGSSYLNTVQKYDPISDTWLDSAGMIYCRCNFGLTAL

SEQ ID NO: 768904 - protein, 107 aa, Homo sapiens
PLYSSLGDTETTSQKNNQSINKRGVHVNESTVLTSAAGWTRGSVPPSVWCRAFRGLASRRGEPGAGCEHCCWPGHSRYAAVPDTSTRPLWANVWNLGTSGVGNRALR

SEQ ID NO: 768905 - protein, 106 aa, Homo sapiens
MLGPGQDSVSSQRSWDRGEGRSGSQRERQEVAKAESACAPSPTPLLCPWAVSTSPPQLPRSERGEAEQAADPATWGRGRRGWHCGALSAYCKLCLPGSSDSCASAS

SEQ ID NO: 768906 - protein, 819 aa, Homo sapiens
MSGTSKESLGHGGLPGLGKTCLTTMDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 768907 - protein, 304 aa, Homo sapiens
AVWLCLCRGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 768908 - protein, 92 aa, Homo sapiens
SQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 768909 - protein, 92 aa, Homo sapiens; identical to SEQ ID NO: 768908

SEQ ID NO: 768910 - protein, 92 aa, Homo sapiens; identical to SEQ ID NO: 768908

SEQ ID NO: 768911 - protein, 415 aa, Homo sapiens
MATRNSPMPLGTAQGDPGEAGTRPGPDASLRDTGAATQLKMKPRKVHKIKAVIIDLGSQYCKCGYAGEPRPTYFISSTVGKRCPEAADAGDTRKWTLVGHELLNTEAPLKLVNPLKHGIVVDWDCVQDIWEYIFRTAMKILPEEHAVLVSDPPLSPSSNREKYAELMFETFGIPAMHVTSQSLLSIYSYGKTSGLVVESGHGVSHVVPISEGDVLPGLTSRADYAGGDLTNYLMQLLNEAGHAFTDDHLHIIEHIKKKCCYAAFLPEEELGLVPEELRVDYELPDGKLITIGQERFRCSEMLFQPSLAGSTQPGLPELTAACLGRCQDTGFKEEMAANVLLCGGCTMLDGFPERFQRELSLLCPGDSPAVAAAPERKTSVWTGGSILASLQAFQQLWVSKEEFEERGSVAIYSKC

SEQ ID NO: 768912 - protein, 270 aa, Homo sapiens
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768913 - protein, 281 aa, Homo sapiens
SQVRPGLSDEGRAAPPLPPPRADSASQKMHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768914 - protein, 129 aa, Homo sapiens
DPHFPPGKQVITYFRIYFGSPLGNLAPEGQDFGPGHDCKPREPQPKMASLKLLARAPLVAMYPGLAGLPFASPRRQPFFCNHTPCLATTPGCSCSEAPGILFLVTAPNGISVITGPPFLSGLFWGCSWK

SEQ ID NO: 768915 - protein, 238 aa, Homo sapiens
MHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPGPSLWGALALAGRLVSGGRPLGGGL

SEQ ID NO: 768916 - protein, 233 aa, Homo sapiens
VVNLDGPPADRRRTRADSASQKMHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAAKSCEHTGGFDAGFTETSG

SEQ ID NO: 768917 - protein, 47 aa, Homo sapiens
MRNGKKARMDVYARMDVYARMDVYARMDVYARMDVYARMDVYARMDV

SEQ ID NO: 768918 - protein, 270 aa, Homo sapiens; identical to SEQ ID NO: 768912

SEQ ID NO: 768919 - protein, 311 aa, Homo sapiens
MPGWYRTEVLWIAPRNLLNFLEPSRAAPPLPPPRADSASQKMHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768920 - protein, 281 aa, Homo sapiens; identical to SEQ ID NO: 768913

SEQ ID NO: 768921 - protein, 270 aa, Homo sapiens; identical to SEQ ID NO: 768912

SEQ ID NO: 768922 - protein, 270 aa, Homo sapiens; identical to SEQ ID NO: 768912

SEQ ID NO: 768923 - protein, 270 aa, Homo sapiens; identical to SEQ ID NO: 768912

SEQ ID NO: 768924 - protein, 270 aa, Homo sapiens; identical to SEQ ID NO: 768912

SEQ ID NO: 768925 - protein, 270 aa, Homo sapiens; identical to SEQ ID NO: 768912

SEQ ID NO: 768926 - protein, 312 aa, Homo sapiens
RRSDGPSRALPPRAAEDALELPRPSRAAPALPPPRADSASQKMHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768927 - protein, 215 aa, Homo sapiens
MHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768928 - protein, 253 aa, Homo sapiens
MHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768929 - protein, 240 aa, Homo sapiens
MERKVLPCFLCLFQGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768930 - protein, 147 aa, Homo sapiens
MHYYRYSNAKVSCWYKYLLFSYNIIFWNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 768931 - protein, 270 aa, Homo sapiens; identical to SEQ ID NO: 768912

SEQ ID NO: 768932 - protein, 270 aa, Homo sapiens; identical to SEQ ID NO: 768912

SEQ ID NO: 768933 - protein, 270 aa, Homo sapiens; identical to SEQ ID NO: 768912

SEQ ID NO: 768934 - protein, 270 aa, Homo sapiens; identical to SEQ ID NO: 768912

SEQ ID NO: 768935 - protein, 227 aa, Homo sapiens
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAPLFLLHILQPPSMHPTYKHSPTPQRGLTVFWSWCY

SEQ ID NO: 768936 - protein, 210 aa, Homo sapiens
RRSDGPSRALPPRAAEDALELPRPSRAAPALPPPRADSASQKMHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKAKHSPTPQRGLTVFWSWCY

SEQ ID NO: 768937 - protein, 104 aa, Homo sapiens
SSSATFVEEQRHCKPREPQPKMASLKLLARAPLVAMYPGLAGLPFASPRRQPFFCNHTPCLATTPGCSCSEAPGILFLVTAPNGISVITGPPFLSGLFWGCSWK

SEQ ID NO: 768938 - protein, 105 aa, Homo sapiens
MYEQNVTVNDHKRKQKVLGPNQKLKFNPTELIIYCKDFRIVRFRFDESGPESAKKLAGVVFLGVGLWAWSEKGVLSDLTKVTQGWLACHLPLPGDSRSSATTPRA

SEQ ID NO: 768939 - protein, 126 aa, Homo sapiens
FLAEQRGCQSHQGTHLMASHLTMHMLTLKPWGLSCTPSSTLVHPLSGSCQRYFSCPVFLSLAFLSHPKNLPRPYGSLPFFPRQLLIWAVCTPSFAPPTMPHVAESCLSQLSTLAFFSLCSTRHCTS

SEQ ID NO: 768940 - protein, 266 aa, Homo sapiens
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKAVSTSPAGPPIEHATSLCCLELSLAGASGLLCGLSACSLADSREAVEQATPPLVCSTLPACGCLVGQPFPIGIGQASPAAPEATHPPRARPSSFGPRSFQSCPIAIPAAILLRRCIP

SEQ ID NO: 768941 - protein, 266 aa, Homo sapiens; identical to SEQ ID NO: 768940

SEQ ID NO: 768942 - protein, 266 aa, Homo sapiens; identical to SEQ ID NO: 768940

SEQ ID NO: 768943 - protein, 247 aa, Homo sapiens
LVGTREDWVYLMEDIVDGIDLASEQREEIITSAIDLRVTDIGFSWRIRKEPGECERYQSLRLGKYSTDESITSLAELVVQKISPRHSEPVKRVLALTETCLVERDPATYNMATLKPLGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAK

SEQ ID NO: 768944 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 768945 - protein, 375 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQAA

SEQ ID NO: 768946 - protein, 431 aa, Homo sapiens; identical to SEQ ID NO: 768944

SEQ ID NO: 768947 - protein, 431 aa, Homo sapiens; identical to SEQ ID NO: 768944

SEQ ID NO: 768948 - protein, 161 aa, Homo sapiens
ASEALPASREGGVVMELAAATPGPAPLPSASRGLFGDAPPAAARGPVEPGAARLALLPRPALTLLLLLMAAVIRCLEQAYTTDWRATLKTIRNGVHKIDTYLNAALDLLGGEDGLCQYKCSDGSKPFPRYGYKPSPPNGCGSPLFGVHLNIGIPSLTKCCN

SEQ ID NO: 768949 - protein, 120 aa, Homo sapiens
SPLPLAAACSGPCFHSPPRSEDPGLYHVKVGGLTPSLSEPHSALVAVRRLLVHSSYHGTTTSGDIALMELDSPLQASQFSPICLPGPQTPLAIGTVCWVNGLGVHSGEGEGEYALTSPYS

SEQ ID NO: 768950 - protein, 304 aa, Homo sapiens
PRAANIDFLRAEGEGPGGGGLQPRQGESMSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 768951 - protein, 192 aa, Homo sapiens
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 768952 - protein, 193 aa, Homo sapiens
ASRGPVLMDEAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 768953 - protein, 192 aa, Homo sapiens; identical to SEQ ID NO: 768951

SEQ ID NO: 768954 - protein, 136 aa, Homo sapiens
SARYRLQKLAGDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 768955 - protein, 201 aa, Homo sapiens
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKRTGDLRSCEV

SEQ ID NO: 768956 - protein, 119 aa, Homo sapiens
MHFPEPWAYPPWGACWFWGDHLSLHSGAVKLSNFRSQGRPLLKFHLSCSGPKGGGGLGHQRTAWDGSAGTERCAGLAGDGRGGALFLVLCGGCRRPVLLRTAFQPGIRHLPDGLDPVHV

SEQ ID NO: 768957 - protein, 192 aa, Homo sapiens; identical to SEQ ID NO: 768951

SEQ ID NO: 768958 - protein, 192 aa, Homo sapiens; identical to SEQ ID NO: 768951

SEQ ID NO: 768959 - protein, 192 aa, Homo sapiens; identical to SEQ ID NO: 768951

SEQ ID NO: 768960 - protein, 192 aa, Homo sapiens; identical to SEQ ID NO: 768951

SEQ ID NO: 768961 - protein, 196 aa, Homo sapiens
KAYGRGRGLIRRGAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 768962 - protein, 192 aa, Homo sapiens; identical to SEQ ID NO: 768951

SEQ ID NO: 768963 - protein, 119 aa, Homo sapiens; identical to SEQ ID NO: 768956

SEQ ID NO: 768964 - protein, 192 aa, Homo sapiens; identical to SEQ ID NO: 768951

SEQ ID NO: 768965 - protein, 123 aa, Homo sapiens
RNMGLPQQWDFLPHSVCAFPMSERLLGEPQPVRKPCGNSSTDWTLKRACTEKRRPQHASSFEWRGHSLCWDREQRDAETLKMLLDSGLRLGQWQEIPFTQDLQDKRSAWQLHVFFFKLVARLA

SEQ ID NO: 768966 - protein, 452 aa, Homo sapiens
MPPGRWHAAYPAQAQSSRERGRLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEAVALLEELQRDLDGTSWRDPGPAQSPDVHWMGTGALRSAQIWSLASPLRSSSALGDHLEPPYEIEARDFLAGQSDTPAAQMPALFPREGCPGDQVTPTRSLTAQLQETMTFKDVEVTFSQDEWGWLDSAQRNLYRDVMLENYRNMASLVGPFTKPALISWLEAREPWGLNMQAAQPKGNPVAAPTGDDLQSKTNKFILNQEPLEEAETLAVSSGCPATSVSEGIDRSILRESFQQNQSRDKMRDLREGQMEPPKSELIGWGGGETSRWVRGGASPPPALSPLFRITWSGHKDLKDLKVRGLRGLEAPRVNVWETEANQAASTPGPPA

SEQ ID NO: 768967 - protein, 218 aa, Homo sapiens
VEGRGRNKCGGPQSPAPRPSGTLKRRGRVSRARLCQLSDSHGTATNSVWLPRGAGGMSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVCEMM

SEQ ID NO: 768968 - protein, 452 aa, Homo sapiens
VEGRGRNKCGGPQSPAPRPSGTLKRRGRVSRARLCQLSDSHGTATNSVWLPRGAGGMSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRA

SEQ ID NO: 768969 - protein, 517 aa, Homo sapiens
WRVAAGTSAGAGPQSPAPRPSGTLKRRGRVSRARLCQLSDSHGTATNSVWLPRGAGGMSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQAGAQWRDLSSLQPPPPVFKLFSRLSLPSILLGLQFRDPEYGEWFGYLSREGKVALSIKGGPFKGCFHVPRCLAMCEEMLGALLSRPAPAPSPAPTPACRGA

SEQ ID NO: 768970 - protein, 483 aa, Homo sapiens
WRVAAGTSAGAGPQSPAPRPSGTLKRRGRVSRARLCQLSDSHGTATNSVWLPRGAGGMSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRCLAMCEEMLGALLSRPAPAPSPAPTPACRGA

SEQ ID NO: 768971 - protein, 148 aa, Homo sapiens
QICWPQRGRRGWQGPFQTLLTLPSHRGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQMEQPWSKWRDPLDS

SEQ ID NO: 768972 - protein, 150 aa, Homo sapiens
PPWHELLGHVPPGPQAAPAEAPNTTTVSGWSLAVLPLSPLPQVAGRTKRAQSLRRGQTSQSFDHGGHKGSHLQVESSQGCHLAHRTHIGHLHCSCLGVDNPCGQAPGPHLNHPQIQVWWSHNNLHHYWGRILAGHSEESKVPQGLGQDKT

SEQ ID NO: 768973 - protein, 1447 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 768974 - protein, 799 aa, Homo sapiens
MNLGKELSNETHVSNDQQSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 768975 - protein, 817 aa, Homo sapiens
SGLPLGPPWLPVLFGFLLAQLTVSSSRPPPGHAGLPSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 768976 - protein, 1376 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768977 - protein, 755 aa, Homo sapiens
DLSVLVPGAFKPATLLSSSPFHCSKPLPRRRLPNPPAGGRSCTAWSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768978 - protein, 720 aa, Homo sapiens
LLGSLLFWGLCSFGVFAQLTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768979 - protein, 1157 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATSFLSLFPKLRATEQMTNVGC

SEQ ID NO: 768980 - protein, 586 aa, Homo sapiens
RSRCSSSRRGHCSKEQRLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768981 - protein, 1157 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATEVGPMAAETSQSTESSMWIL

SEQ ID NO: 768982 - protein, 1125 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKVLPWGSWVRPAAFGD

SEQ ID NO: 768983 - protein, 512 aa, Homo sapiens
MALEAQSSENDDRSLVLIHKTQHLRQCGLSLRCVHLGSCRWDRGRAPASPARAAWASWAALGGAPHPCDAGSLTAACLAAPQSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768984 - protein, 197 aa, Homo sapiens
MVTLGFLPIEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768985 - protein, 115 aa, Homo sapiens
TRLGTRLVVQHLAAAALHPPGSARTFQTRYLQVLIPPPWPRKRGLLSFQSERTVGPRLPLFAGGLRDPLLTCWLGASLALLERRGSCGPRPVSVRMVPPRRSGQASWCPERLLQE

SEQ ID NO: 768986 - protein, 847 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLNPPPSVLVDTCVALTCVLSLFFQE

SEQ ID NO: 768987 - protein, 646 aa, Homo sapiens
MFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 768988 - protein, 1376 aa, Homo sapiens; identical to SEQ ID NO: 768976

SEQ ID NO: 768989 - protein, 1330 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKEELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768990 - protein, 774 aa, Homo sapiens
MKKHDFAENLPSSLLIIILVIFTLSGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768991 - protein, 713 aa, Homo sapiens
VLCVHMLLCEELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768992 - protein, 718 aa, Homo sapiens [sequence omitted]

SEQ ID NO: 768993 - protein, 835 aa, Homo sapiens
RPHTARVRRDGGAPPHCSRQEGRGRPHTARIQWTRVMNGDFLGTSLLFIRELRRYWEPKATEGRFADTSGRIRCPGSALCHIPHRVSCKGAAEPTCVAEGLALDTVPESFVLRRSPHAEQCAVTGVWASHPEELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768994 - protein, 1190 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEGM

SEQ ID NO: 768995 - protein, 1382 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLLLISAQSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768996 - protein, 949 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768997 - protein, 464 aa, Homo sapiens
MSLCFPCQDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 768998 - protein, 464 aa, Homo sapiens; identical to SEQ ID NO: 768997

SEQ ID NO: 768999 - protein, 943 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADGLWGGSWAVVSRPGSRVPVLASL

SEQ ID NO: 769000 - protein, 679 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLEWSTCARRCGNGYP

SEQ ID NO: 769001 - protein, 319 aa, Homo sapiens
PGRVRGRGGNMEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 769002 - protein, 178 aa, Homo sapiens
DWEVRTGLDLHSEVGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGMALRGPRVLPPRGGRSAGVGSERGPCSSRGRVGRGLMAEQGNVGLEPHLTVH

SEQ ID NO: 769003 - protein, 319 aa, Homo sapiens; identical to SEQ ID NO: 769001

SEQ ID NO: 769004 - protein, 254 aa, Homo sapiens
MASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 769005 - protein, 346 aa, Homo sapiens
PGRVRGRGGNMEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVEHNALSGSREFSGILICWHLESVCSPHGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 769006 - protein, 190 aa, Homo sapiens
MRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 769007 - protein, 165 aa, Homo sapiens
MLLQVSQVLVSLLLQTLSLLALQLHRFLQLAQLLLQLAQLLSQLPLDVLLRLQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 769008 - protein, 351 aa, Homo sapiens
PGRVRGRGGNMEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVKAPQQKAEQNRVPLECWFLCGVRKDRECGQFPT

SEQ ID NO: 769009 - protein, 351 aa, Homo sapiens; identical to SEQ ID NO: 769008

SEQ ID NO: 769010 - protein, 191 aa, Homo sapiens
PGRVRGRGGNMEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQILVSSHAGLA

SEQ ID NO: 769011 - protein, 319 aa, Homo sapiens; identical to SEQ ID NO: 769001

SEQ ID NO: 769012 - protein, 226 aa, Homo sapiens
VGPSRQHLCCSTPPTGWVHPDSTCAARLPPLGRSILTAPVLLDSPHWVGPSRQHLCCSDYPPGRSIPTAPVPLTSLPDVCVCRLAPHQVGPSRQHLCRSPPHRVGPSRQHLCRSPPCRVGPSRRRVCRLAQGPDIVPLSTASGARDPGHHRSVSAHQVPGARTSSFHSAQHQVPGTLDIIVPLSTASGAWDPGHHRSAQHSIRCPGPWTSFCISTTSPVTRASPSG

SEQ ID NO: 769013 - protein, 78 aa, Homo sapiens
PGRVRGRGGNMEELLRRELGCSSVRATGHSGGGCISQGRSYDTDQGRVFVKVNPKAEARRMFEGEMASLTAIAAGACW

SEQ ID NO: 769014 - protein, 191 aa, Homo sapiens
PGRVRGRGGNMEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGMALRGPRVLPPRGGRSAGVGSERGPCSSRGRVGRGLMAEQGNVGLEPHLTVH

SEQ ID NO: 769015 - protein, 3829 aa, Homo sapiens
MNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRFYTSWNQEATSHKSERQQQNKEKCPPSAGQTYSQRFFVPPTFKSVGNPVEARRWLRQARANFSAARNDLHKNANEWVCFKCYLSTKLALIAADYAVRGKSDKDVKPTALAQKIEEYSQQLEGLTNDVHTLEAYGVDSLKTRYPDLLPFPQIPNDRFTSEVAMRVMECTACIIIKLENFMQQKV

SEQ ID NO: 769016 - protein, 3829 aa, Homo sapiens; identical to SEQ ID NO: 769015

SEQ ID NO: 769017 - protein, 3647 aa, Homo sapiens
MNTFWPGRELIVQWYPFDENRNHPSVSWLKMVWKNLYIHFSEDLTLFDEMPLIPRTILEEGQTCVELIRLRIPSLVILDDESEAQLPEFLADIVQKLGGFVLKKLDASIQHPLIKKYIHSPLPSAVLQIMEKMPLQKLCNQITSLLPTHKDALRKFLASLTDSSEKEKRIIQELAIFKRINHSSDQGISSYTKLKGCKVLHHTAKLPADLRLSISVIDSSDEATIRLANMLKIEQLKTTSCLKLVLKDIENAFYSHEEVTQLMLWVLENLSSLKNENPNVLEWLTPLKFIQISQEQMVSAGELFDPDIEVLKDLFCNEEGTYFPPSVFTSPDILHSLRQIGLKNEASLKEKDVVQVAKKIEALQVGACPDQDVLLKKAKTLLLVLNKNHTLLQSSEGKMTLKKIKWVPACKERPPNYPGSLVWKGDLCNLCAPPDMCDVGHAILIGSSLPLVESIHVNLEKALGIFTKPSLSAVLKHFKIVVDWYSSKTFSDEDYYQFQHILLEIYGFMHDHLNEGKDSFRALKFPWVWTGKKFCPLAQAVIKPIHDLDLQPYLHNVPKTMAKFHQLFKVCGSIEELTSDHISMVIQKIYLKSDQDLSEQESKQNLHLMLNIIRWLYSNQIPASPNTPVPIHHSKNPSKLIMKPIHECCYCDIKVDDLNDLLEDSVEPIILVHEDIPMKTAEWLKVPCLSTRLINPENMGFEQSGQREPLTVRIKNILEEYPSVSDIFKELLQNADDANATECSFLIDMRRNMDIRENLLDPGMAACHGPALWSFNNSQFSDSDFVNITRLGESLKRGEVDKVGKFGLGFNSVYHITDIPIIMSREFMIMFDPNINHISKHIKDKSNPGIKINWSKQQKRLRKFPNQFKPFIDVFGCQLPLTVEAPYSYNGTLFRLSFRTQQEAKVSEVSSTCYNTADIYSLVDEFSLCGHRLIIFTQSVKSMYLKYLKIEETNPSLAQDTVIIKKKSCSSKALNTPVLSVLKEAAKLMKTCSSSNKKLPSDEPKSSCILQITVEEFHHVFRRIADLQSPLFRGPDDDPAALFEMAKSGQSKKPSDELSQKTVECTTWLLCTCMDTGEALKFSLSESGRRLGLVPCGAVGVQLSEIQDQKWTVKPHIGEVFCYLPLRIKTGLPVHINGCFAVTSNRKEIWKTDTKGRWNTTFMRHVIVKAYLQVLSVLRDLATSGELMDYTYYAVWPDPDLVHDDFSVICQGFYEDIAHGKGKELTKVFSDGSTWVSMKNVRFLDDSILKRRDVGSAAFKIFLKYLKKTGSKNLCAVELPSSVKLGFEEAGCKQILLENTFSEKQFFSEVFFPNIQEIEAELRDPLMIFVLNEKVDEFSGVLRVTPCIPCSLEGHPLVLPSRLIHPEGRVAKLFDIKDGRFPYGSTQDYLNPIILIKLVQLGMAKDDILWDDMLERAVSVAEINKSDHVAACLRSSILLSLIDEKLKIRDPRAKDFAAKYQTIRFLPFLTKPAGFSLDWKGNSFKPETMFAATDLYTAEHQDIVCLLQPILNENSHSFRGCGSVSLAVKEFLGLLKKPTVDLVINQLKEVAKSVDDGITLYQENITNACYKYLHEALMQNEITKMSIIDKLKPFSFILVENAYVDSEKVSFHLNFEAAPYLYQLPNKYKNNFRELFETVGVRQSCTVEDFALVLESIDQERGTKQITEENFQLCRRIISEGIWSLIREKKQEFCEKNYGKILLPDTNLMLLPAKSLCYNDCPWIKVKDTTVKYCHADIPREVAVKLGAVPKRHKALERYASNVCFTTLGTEFGQKEKLTSRIKSILNAYPSEKEMLKELLQNADDAKATEICFVFDPRQHPVDRIFDDKWAPLQGPALCVYNNQPFTEDDVRGIQNLGKGTKEGNPYKTGQYGIGFNSVYHITDCPSFISGNDILCIFDPHARYAPGATSISPGRMFRDLDADFRTQFSDVLDLYLGTHFKLDNCTMFRFPLRNAEMAKVSEISSVPASDRMVQNLLDKLRSDGAELLMFLNHMEKISICEIDKSTGALNVLYSVKGKITDGDRLKRKQFHASVIDSVTKKRQLKDIPVQQITYTMDTEDSEGNLTTWLICNRSGFSSMEKVSKSVISAHKNQDITLFPRGGVAACITHNYKKPHRAFCFLPLSLETGLPFHVNGHFALDSARRNLWRDDNGVGVRSDWNNSLMTALIAPAYVELLIQLKKRYFPGSDPTLSVLQNTPIHVVKDTLKKFLSFFPVNRLDLQPDLYCLVKALYNCIHEDMKRLLPVVRAPNIDGSDLHSAVIITWINMSTSNKTRPFFDNLLQDELQHLKNADYNITTRKTVAENVYRLKHLLLEIGFNLVYNCDETANLYHCLIDADIPVSYVTPADIRSFLMTFSSPDTNCHIGKLPCRLQQTNLKLFHSLKLLVDYCFKDAEENEIEVEGLPLLITLDSVLQTFDAKRPKFLTTYHELIPSRKDLFMNTLYLKYSNILLNCKVAKVFDISSFADLLSSVLPREYKTKSCTKWKDNFASESWLKNAWHFISESVSVKEDQEETKPTFDIVVDTLKDWALLPGTKFTVSANQLVVPEGDVLLPLSLMHIAVFPNAQSDKVFHALMKAGCIQLALNKICSKDSAFVPLLSCHTANIESPTSILKALHYMVQTSTFRAEKLVENDFEALLMYFNCNLNHLMSQDDIKILKSLPCYKSISGRYVSIGKFGTCYVLTKSIPSAEVEKWTQSSSSAFLEEKIHLKELYEVIGCVPVDDLEVYLKHLLPKIENLSYDAKLEHLIYLKNRLSSAEELSEIKEQLFEKLESLLIIHDANSRLKQAKHFYDRTVRVFEVMLPEKLFIPNDFFKKLEQLIKPKNHVTFMTSWVEFLRNIGLKYILSQQQLLQFAKEISVRANTENWSKETLQNTVDILLHHIFQERMDLLSGNFLKELSLIPFLCPERAPAEFIRFHPQYQEVNGTLPLIKFNGAQVNPKFKQCDVLQLLWTSCPILPEKATPLSIKEQEGSDLGPQEQLEQVLNMLNVNLDPPLDKVINNCRNICNITTLDEEMVKTRAKVLRSIYEFLSAEKREFRFQLRGVAFVMVEDGWKLLKPEEVVINLEYESDFKPYLYKLPLELGTFHQLFKHLGTEDIISTKQYVEVLSRIFKNSEGKQLDPNEMRTVKRVVSGLFRSLQNDSVKVRSDLENVRDLALYLPSQDGRLVKSSILVFDDAPHYKSRIQGNIGVQMLVDLSQCYLGKDHGFHTKLIMLFPQKLRPRLLSSILEEQLDEETPKVCQFGALCSLQGRLQLLLSSEQFITGLIRIMKHENDNAFLANEEKAIRLCKALREGLKVSCFEKLQTTLRVKGFNPIPHSRSETFAFLKRFGNAVILLYIQHSDSKDINFLLALAMTLKSATDNLISDTSYLIAMLGCNDIYRIGEKLDSLGVKYDSSEPSKLELPMPGTPIPAEIHYTLLMDPMNVFYPGEYVGYLVDAEGGDIYGSYQPTYTYAIIVQEVEREDADNSSFLGKIYQIDIGYSEYKIVSSLDLYKFSRPEESSQSRDSAPSTPTSPTEFLTPGLRSIPPLFSGRESHKTSSKHQSPKKLKVNSLPEILKEVTSVVEQAWKLPESERKKIIRRLYLKWHPDKNPENHDIANEVFKHLQNEINRLEKQAFLDQNADRASRRTFSTSASRFQSDKYSFQRF

SEQ ID NO: 769018 - protein, 66 aa, Homo sapiens
RCGKELPTSGLFDSPGLPAAGGSYPCRVSLTHQDNLPMERSYPLSVSSAESWTLGMTCLRYPLWVS

SEQ ID NO: 769019 - protein, 1358 aa, Homo sapiens
MGADGETVVLKNMLIGVNLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 769020 - protein, 250 aa, Homo sapiens
YVFNTYFIFLTFQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEH

SEQ ID NO: 769021 - protein, 440 aa, Homo sapiens
AARGRRPLTSSPQRRLPAGPRPPTVEPPAEPPAEVPPSGTPPPPSTSEPLSRRRPMWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 769022 - protein, 103 aa, Homo sapiens
TQLSKMQTLHLASPAPSAFWAWSFLATPFSVGLFPSLPASAFPFFPLGTFSGAFLGLLWLWRSRFSRQLCGSSLWFILHLGFISFSIPLSLSLGHAGNNSDGT

SEQ ID NO: 769023 - protein, 128 aa, Homo sapiens
GVARPALGAQSRRPGRGCGNPWLGGAERQAGPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 769024 - protein, 224 aa, Homo sapiens
VLPAPHSEPRAAAQEGDAETPGSVERRGRRAGAEDGMSQAPGAQPSPPTVYHERQRLELCAVHALNNVLQQQLFSQEAADEICKRLAPDSRLNPHRSLLGTGNYDVNVIMAALQGLGLAAVWWDRRRPLSQLALPQVLGLILNLPSPVSLGLLSLPLRRRHWVALRQVDGVYYNLDSKLRAPEALGDEDGVRAFLAAALAQGLCEVLLVVTKEVEEKGSWLRTD

SEQ ID NO: 769025 - protein, 113 aa, Homo sapiens
APRLSLLFPSFPPTVAKEGKGEGRVLESPHLTGCFQLSGSGRYLKMTISWALSQALRRLSALGTSTEDPSKSAMHQLWGPLPTRLPPLPFVCSDSGYWSHAILQEFLRIESRI

SEQ ID NO: 769026 - protein, 1262 aa, Homo sapiens
MSQKRQTKFQNGKSKTSENSSAKREKGMVVNSKEISDAVGQSKFVLENLRHYTVHPNLAQYYKPLKATALQKFLAQNRKNTSFMLKVTQYDQDKTLLIMTNNPPPCSITQQDKESASKYFSKELLLKVMESHHQHKPTENLWLPRMPQKKKLRSKLKPIFPLILSDDPTSKREQWFRFSTDNDFKSEGKYSKVYALRTQKKMYPQLTFAPVHERDMRKDASKKSASERPISKVIREPLTLASLLEDMPTRTAPGESAFRNGRAPQWIIKKATVIVVNTDPSVLPPRSLETEGSAEVATQIKPHSCCCGRGLPGRKPGGSSRSLRRAARGEGGVAASRGPRAAGEGGPWPRVKARRPNRRESAGPAFLQLFRSPAAAPGTVAVGLGAGKSSKMIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMGKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDAFEKEETFALSSTKTLVEAVNNIITFLGMQPCERSDKVPENKNSHSLYLAGIFRGGYDLLVRSRLALADGVTMQVTVRSKERTPVDVILASVG

SEQ ID NO: 769027 - protein, 765 aa, Homo sapiens
MILTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMGKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDAFEKEETFALSSTKTLVEAVNNIITFLGMQPCERSDKVPENKNSHSLYLAGIFRGGYDLLVRSRLALADGVTMQVTVRSKERTPVDVILASVG

SEQ ID NO: 769028 - protein, 344 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIERFIEPHEMQQPLVVLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEGG

SEQ ID NO: 769029 - protein, 400 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEGG

SEQ ID NO: 769030 - protein, 400 aa, Homo sapiens; identical to SEQ ID NO: 769029

SEQ ID NO: 769031 - protein, 400 aa, Homo sapiens; identical to SEQ ID NO: 769029

SEQ ID NO: 769032 - protein, 239 aa, Homo sapiens
RARRLALQCHVCVCALTPGEQSGRRLPGQTWLMFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVQGPGASINPERACPMGTDSADPSPVHKDG

SEQ ID NO: 769033 - protein, 123 aa, Homo sapiens
GPCLEQQDEERSTRLKDLLGRYFEEEEGQEPGGMEDAQGPEPGQARVSAVRPGSSSGLQVPWAAWGLLCGCSATGAQRKPDVPVHTAPGLGGPGPLRHPPVPVPEARGEVLQQGCGPHLPRHR

SEQ ID NO: 769034 - protein, 243 aa, Homo sapiens
MRGHISVLVAIRQCRLVVPCAGARADGCCACGGADAGDAGVLGDEDARLFPDGSAAVSVSDAEAYGAGCPGAEGLRARPAADAFPLQDDVEAAPEETRALYREYRTLKRTTGQAGGGLRSSESLPAAAEEAPEPRCWGPHLNRAATKSPQPTPGRSRQGSVPDYGQRLKANLKGTLQAGPALGRRPWPLGRASSKASTPKPPGTGPVPSFAEKVSDEPPQAPAGGPLTALHWGMSGRAGVVRG

SEQ ID NO: 769035 - protein, 282 aa, Homo sapiens
WSECTFFSTTPVLSLFAVFIQLAEKTYNYIYIEIACFLSIFFLSICVYSTVFRIRVFNYYYLASHHQTDAYSLLFSGMLFCRLTPPLCLNFLVFDPYGFIYLSQEYSTNCLYIYGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 769036 - protein, 294 aa, Homo sapiens
WSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 769037 - protein, 107 aa, Homo sapiens
AGCTPRDLWDGRDGLALPGVGVARAWALAEFQARAEEGAAAAAAAAAGGYPSTGRCRCSLRGMEGTAVAVFEVMLGRERRGRTLSEETGFVRRPRSLGRGVGRRLRF

SEQ ID NO: 769038 - protein, 337 aa, Homo sapiens
MLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769039 - protein, 374 aa, Homo sapiens [sequence omitted]

SEQ ID NO: 769040 - protein, 374 aa, Homo sapiens [sequence omitted]

SEQ ID NO: 769041 - protein, 374 aa, Homo sapiens [sequence omitted]

SEQ ID NO: 769042 - protein, 374 aa, Homo sapiens [sequence omitted]

SEQ ID NO: 769043 - protein, 407 aa, Homo sapiens
MLNLTCLFSDSRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769044 - protein, 531 aa, Homo sapiens
MVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVREGVKPCCPSACFTLLSSTNRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769045 - protein, 421 aa, Homo sapiens
AGCTPRDLWDGRDGLALPGVGVARAWALAEFQARAEEGAAAAAAAAAGGYPSTGRCRCSLRGMEGTAVAVFGWSLTLLPRPECSGAVSAHCNLHLPGSSDSHASVPRVAGITDAHHHAWLIMVASAGSLFGGMVLKKFLKDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769046 - protein, 401 aa, Homo sapiens
MLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLAVLKQPSQPTAAGVQQLSHSVTSRDARYHTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769047 - protein, 304 aa, Homo sapiens
MLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 769048 - protein, 125 aa, Homo sapiens
AGCTPRDLWDGRDGLALPGVGVARAWALAEFQARAEEGAAAAAAAAAGGYPSTGRCRCSLRGMEGTAVAVFGCFCRKPFWWHGPQEVPKRNTVHTARNLCKADLDFRGRQLFSGYDRGNTLPDDF

SEQ ID NO: 769049 - protein, 374 aa, Homo sapiens [sequence omitted]

SEQ ID NO: 769050 - protein, 374 aa, Homo sapiens [sequence omitted]

SEQ ID NO: 769051 - protein, 374 aa, Homo sapiens [sequence omitted]

SEQ ID NO: 769052 - protein, 374 aa, Homo sapiens [sequence omitted]

SEQ ID NO: 769053 - protein, 374 aa, Homo sapiens [sequence omitted]

SEQ ID NO: 769054 - protein, 288 aa, Homo sapiens
MLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTTRGGGGP

SEQ ID NO: 769055 - protein, 179 aa, Homo sapiens
MGLIFAKLWSLFCNQEHKVIIVGLDNAGKTTILYQFLMNEVVHTSPTIGSNVEEIVVKNTHFLMWDIGGQESLRSSWNTYYSNTEFIILVVDSIDRERLAITKEELYRMLAHEDLRKAAVLIFANKQDMKGCMTAAEISKYLTLSSIKDHPWHIQSCCALTGEGLCQGLEWMTSRIGVR

SEQ ID NO: 769056 - protein, 76 aa, Homo sapiens
ASQTRFQMALHRPWTVLAEVGFSSLKSPGSGALILMNRSYVWDEWSLAHRTTLILEGRNEDRTIVILEGLNKYLLA

SEQ ID NO: 769057 - protein, 200 aa, Homo sapiens
AGLLETPGWKGPWPPVTCKGEMRLVRELWASPVAARCLSINSSHPAAPPTHLCTRHGPKKAPGSTEWLGEFLYSLLTWVLDYRLPQGRGRQGHLFIFLSSAPRTVTGTERAHSKYIPSVRVNDYSRFPEAGVGRKWPLLRSPGSPSPAVCFPLSRIKSNVDGRYLVDGVPFSCCNPSSPRPCIQYQITNNSAHYSYDHQT

SEQ ID NO: 769058 - protein, 346 aa, Homo sapiens
MALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESEGWLLEKSVPETWKAFLESVKKLGKGNQVEAEGAGAGQAPEAG

SEQ ID NO: 769059 - protein, 103 aa, Homo sapiens
FQARDRQTVLQATEMEDNGHRTQVAFIPGQPQSKPHRTLHILDSDPISHPSCVPETTTSTNRPVIRLFFSKHTSSCTLMKTWLPLELSGVEISFRRIPLPLGL

SEQ ID NO: 769060 - protein, 82 aa, Homo sapiens
KDEIVFFKTVKFCKTQEPVQGNKHLHNRWNQELNVIVASLSTGQQTTRPACEMAAPQPCSVTSFLSNERQQLPADCSIVFIN

SEQ ID NO: 769061 - protein, 330 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRVEMGFCHVGQNGFELLTSSYLPASASQSAEIIAVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 769062 - protein, 351 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 769063 - protein, 302 aa, Homo sapiens
MVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 769064 - protein, 351 aa, Homo sapiens; identical to SEQ ID NO: 769062

SEQ ID NO: 769065 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATIIQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 769066 - protein, 1124 aa, Homo sapiens; identical to SEQ ID NO: 769065

SEQ ID NO: 769067 - protein, 767 aa, Homo sapiens
SIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 769068 - protein, 767 aa, Homo sapiens; identical to SEQ ID NO: 769067

SEQ ID NO: 769069 - protein, 757 aa, Homo sapiens
SIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLERENLRVTEPKDQCLILLTWKRKLRGGKRSACSRPERQNQGSATPSASA

SEQ ID NO: 769070 - protein, 324 aa, Homo sapiens
SIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQINGRQKYCSETSGSRMCFIPACLRMWSCL

SEQ ID NO: 769071 - protein, 298 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 769072 - protein, 298 aa, Homo sapiens; identical to SEQ ID NO: 769071

SEQ ID NO: 769073 - protein, 298 aa, Homo sapiens; identical to SEQ ID NO: 769071

SEQ ID NO: 769074 - protein, 298 aa, Homo sapiens; identical to SEQ ID NO: 769071

SEQ ID NO: 769075 - protein, 305 aa, Homo sapiens
MPSLRNFLNDSSYQFSFIKPCYDAARSPLPDAGALTLDFSASRTVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 769076 - protein, 260 aa, Homo sapiens
KEFRGMLDLQQQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 769077 - protein, 298 aa, Homo sapiens; identical to SEQ ID NO: 769071

SEQ ID NO: 769078 - protein, 152 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLTVSSRSSSLMA

SEQ ID NO: 769079 - protein, 228 aa, Homo sapiens [sequence omitted]

SEQ ID NO: 769080 - protein, 208 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKVSGIIEASE

SEQ ID NO: 769081 - protein, 282 aa, Homo sapiens [sequence omitted]

SEQ ID NO: 769082 - protein, 228 aa, Homo sapiens [sequence omitted]

SEQ ID NO: 769083 - protein, 73 aa, Homo sapiens
VSGEKSLSSSVTEPSPAFVSTADIMYTGTVDCWRKIAKDEGAKAFFKGAWSNVLRGMGGAFVLVLYDEIKKYV

SEQ ID NO: 769084 - protein, 228 aa, Homo sapiens [sequence omitted]

SEQ ID NO: 769085 - protein, 252 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGCCLTPRTCYKITTVFSHAQTVVLCVGCSTVLCQPTGGKARLTEGCSFRRKQH

SEQ ID NO: 769086 - protein, 40 aa, Homo sapiens
MMNETQYLLSNMLSSKGIRKAMLVSSYNSCHQRNKPTPGI

SEQ ID NO: 769087 - protein, 152 aa, Homo sapiens
TGFELSLPFVYLFVSCLRWSLALSPRLECSGVILAHCNLCLQGSSDSHASASQKTGITGAHHHTQLIFVFLVETVFHHVGQAHLKLLTSSDPPDSACQSAGITGVSHCTWPADLKKSMHCFTLKYKVDLIFYEISLVYASFRKKQIRAEFSL

SEQ ID NO: 769088 - protein, 257 aa, Homo sapiens
EPALCTLCACPSGRPSMRGPTVLLTVALPTLLAPRAGAPVQSQGSRNKLLLVSFDSFRWNYEQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRSTD

SEQ ID NO: 769089 - protein, 75 aa, Homo sapiens
FLVHTGEKPFRCTFEGCGKRFSLDFNLRTHVRIHTGEKRFVCPFQGCNRRFIQSNNLKAHILTHANTNKNEQEGK

SEQ ID NO: 769090 - protein, 132 aa, Homo sapiens
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRKLVNGKMVAECKMKGVVCTRIYEKV

SEQ ID NO: 769091 - protein, 132 aa, Homo sapiens; identical to SEQ ID NO: 769090

SEQ ID NO: 769092 - protein, 456 aa, Homo sapiens
MQRGTPDPSLPWGEGCGTQRGRGRGHWPRGGRRCCHSRYCPPWDPSLEPPILWLLPVATQLSGGHMHIPCSFPAHLPCPVAFLVPATETGELLQGEAAFWLLVYLDTDRPLVSRGAPCSPHGQQDTQDRPPPRSTWALGAAAFRMPPVPGRLVFSFCPEDERGSAVARARGRGSRSPLCGRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 769093 - protein, 128 aa, Homo sapiens
EQEDGEESPSDGSPIELEPSDQPHGLLRAGGWGGEPQRRQPHRAGLNWPGHVETPRSTTAGGTFQRRVLGGSSPWGLLALRLAVAACRRVSVSVRRLRVARLLLTVLLGPKSGASPLLAAASPEIDPQ

SEQ ID NO: 769094 - protein, 103 aa, Homo sapiens
MRFCPWPHWRHREARRVWELVFPECPVPDGSRPPLSQSCPCRTGTRTAGHRVSGPVEAPAVVLGYMSQSKHTEARELMYSGALLFFSHGQKTVQQTTDDTTWY

SEQ ID NO: 769095 - protein, 359 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 769096 - protein, 359 aa, Homo sapiens; identical to SEQ ID NO: 769095

SEQ ID NO: 769097 - protein, 359 aa, Homo sapiens; identical to SEQ ID NO: 769095

SEQ ID NO: 769098 - protein, 359 aa, Homo sapiens; identical to SEQ ID NO: 769095

SEQ ID NO: 769099 - protein, 283 aa, Homo sapiens
MYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 769100 - protein, 310 aa, Homo sapiens
ASRKRALERGGQAARQSEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 769101 - protein, 338 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEVRAWGWGGRRGPHGLGPPPLSPLPVPCSTSTA

SEQ ID NO: 769102 - protein, 339 aa, Homo sapiens
MRFCPWPHWRHREARRVWELVFPECPVPDGSRPPLSQSCPCRTGTRTAGHRVSGPVEAPAVVLGYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 769103 - protein, 220 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKDAGGVFHVPRLPQRGGHVRGPGRATVSLFKKQK

SEQ ID NO: 769104 - protein, 140 aa, Homo sapiens
MCLAVPRPHRTAVLRRPAQADVFLRGPAREPSDQPHGLLRAGGWGGEPQRRQPHRAGLNWPGHVETPRSTTAGGTFQRRVLGGSSPWGLLALRLAVAACRRVSVSVRRLRVARLLLTVLLGPKSGASPLLAAASPEIDPQ

SEQ ID NO: 769105 - protein, 285 aa, Homo sapiens
RRRASGGRRDGSREALPTAPATASARGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGVARLLLTVLLGPKSGASPLLAAASPEIDPQ

SEQ ID NO: 769106 - protein, 240 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMGRRAPATAAPSSWTELARPRGDTTVDDGWRDVSEASPGWLLALGAPGPEAGGGRMPARVCFCAAAQGGAAAAHCAAGTQEWGVAPAGRRVPRD

SEQ ID NO: 769107 - protein, 107 aa, Homo sapiens
GEPHPPALRSPWRMGRRAPATAAPSSWTELARPRGDTTVDDGWRDVSEASPGWLLALGAPGPEAGGGRMPARVCFCAAAQGGAAAAHCAAGTQEWGVAPAGRRVPRD

SEQ ID NO: 769108 - protein, 79 aa, Homo sapiens
ERIVSSLQVGAGGTFQRRVLGGSSPWGLLALRLAVAACRRVSVSVRRLRVARLLLTVLLGPKSGASPLLAAASPEIDPQ

SEQ ID NO: 769109 - protein, 311 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGVARLLLTVLLGPKSGASPLLAAASPEIDPQ

SEQ ID NO: 769110 - protein, 359 aa, Homo sapiens; identical to SEQ ID NO: 769095

SEQ ID NO: 769111 - protein, 338 aa, Homo sapiens; identical to SEQ ID NO: 769101

SEQ ID NO: 769112 - protein, 337 aa, Homo sapiens
MQRGTPDPSLPWGEGCGTQRGRGRGHWPRGGRRCCHSRYCPPWDPSLEPPILWLLPVATQLSGGHMHIPCSFPAHLPCPVAFLVPATETGELLQGEAAFWLLVYLDTDRPLVSRGAPCSPHGQQDTQDRPPPRSTWALGAAAFRMPPVPGRLVFSFCPEDERGSAVARARGRGSRSPLCGRYMSQSKHTEARELMYSGALLFFSHGQQNSAADLSMLVLESLEKAEVEVADELLENLAKVFSLMGRRAPATAAPSSWTELARPRGDTTVDDGWRDVSEASPGWLLALGAPGPEAGGGRMPARVCFCAAAQGGAAAAHCAAGTQEWGVAPAGRRVPRD

SEQ ID NO: 769113 - protein, 324 aa, Homo sapiens
AEKGVGRPSGRKPGGAADRACDSVSPARSAGPMAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGVRLGILQGEGAVNVRVVCRRGVDSCVGVCASVAMVWVAVWVYA

SEQ ID NO: 769114 - protein, 655 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 769115 - protein, 655 aa, Homo sapiens; identical to SEQ ID NO: 769114

SEQ ID NO: 769116 - protein, 655 aa, Homo sapiens; identical to SEQ ID NO: 769114

SEQ ID NO: 769117 - protein, 655 aa, Homo sapiens; identical to SEQ ID NO: 769114

SEQ ID NO: 769118 - protein, 680 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKPGSGVSAETWRDHLLAPFTIYLQLWNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 769119 - protein, 689 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKEGNGLGHKNCLFDLLRNCQTAEKWLHHFTFLPCKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 769120 - protein, 562 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 769121 - protein, 324 aa, Homo sapiens [sequence omitted]

SEQ ID NO: 769122 - protein, 324 aa, Homo sapiens [sequence omitted]

SEQ ID NO: 769123 - protein, 324 aa, Homo sapiens [sequence omitted]

SEQ ID NO: 769124 - protein, 324 aa, Homo sapiens [sequence omitted]

SEQ ID NO: 769125 - protein, 324 aa, Homo sapiens [sequence omitted]

SEQ ID NO: 769126 - protein, 324 aa, Homo sapiens [sequence omitted]

SEQ ID NO: 769127 - protein, 168 aa, Homo sapiens
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIR

SEQ ID NO: 769128 - protein, 266 aa, Homo sapiens
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRG

SEQ ID NO: 769129 - protein, 180 aa, Homo sapiens
MRSIRKRWTICTISLLLIFYKTKEIARTEEHQETQLIGDGELSLSRSLVNSSDKIIRKAGSSIFQHNVEGWKINSSLVLEIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRG

SEQ ID NO: 769130 - protein, 359 aa, Homo sapiens
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 769131 - protein, 133 aa, Homo sapiens
MHKVSHLKRNLSPRRRRGATLAELAQTGREVAGQRSRTRGSSATEDPSDLIPGSRLQALLAFYRFHPRDYLPKTEPLYQEKVRELGQPGLSRAPKMRSIRKRWTICTISLLLIFYKTKEIARTEEHQETQLIG

SEQ ID NO: 769132 - protein, 155 aa, Homo sapiens
RKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFK

SEQ ID NO: 769133 - protein, 194 aa, Homo sapiens
RKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 769134 - protein, 234 aa, Homo sapiens
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 769135 - protein, 145 aa, Homo sapiens
SCIWFVDGGGLIKYQTTDSNVLLNRRRLFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 769136 - protein, 458 aa, Homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 769137 - protein, 458 aa, Homo sapiens; identical to SEQ ID NO: 769136

SEQ ID NO: 769138 - protein, 458 aa, Homo sapiens; identical to SEQ ID NO: 769136

SEQ ID NO: 769139 - protein, 258 aa, Homo sapiens
MKMLKADLIASSDIEEFLRKAACMKEFDHPHVAKLVGVKPLSLWSRAKGCHPIPVVILPFMKHGDLHAFLLTSWLGENPFTLIRFMVDIACSMEYLSSRNFIHRDLAARNCMLAGDMTVCVADFGLSWKIYSGATIVRAVPPNVPVKWLALESLADNLYTVHSDVWAFGVTMWEIMTRGQTPYAGIENTEIYNYLIGGNHLKQLPECMEDVLTLPLHPSQGLLRPSDDLLYDLMYQCWSADPKQRPSFTCLRMELENI

SEQ ID NO: 769140 - protein, 366 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769141 - protein, 345 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769142 - protein, 366 aa, Homo sapiens; identical to SEQ ID NO: 769140

SEQ ID NO: 769143 - protein, 222 aa, Homo sapiens
MELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769144 - protein, 394 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSVREEPRHPRSPSRNPGPAPPTLPRGLASSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769145 - protein, 351 aa, Homo sapiens
MSEEEQGSGTTTGCGLPSLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769146 - protein, 345 aa, Homo sapiens; identical to SEQ ID NO: 769141

SEQ ID NO: 769147 - protein, 366 aa, Homo sapiens; identical to SEQ ID NO: 769140

SEQ ID NO: 769148 - protein, 374 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQSLRLLRGDQRGCEKPFFTQPHAPCVSLSKELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769149 - protein, 328 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVSLLFLPLGSCICAALVPSVGAISTSDTDCLP

SEQ ID NO: 769150 - protein, 268 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLQVKPQLDSWMCTLCSLLFLPLGSCICAALVPSVGAISTSDTDCLP

SEQ ID NO: 769151 - protein, 109 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSR

SEQ ID NO: 769152 - protein, 222 aa, Homo sapiens; identical to SEQ ID NO: 769143

SEQ ID NO: 769153 - protein, 256 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGCGLPPGWSSKPGPRLHLGFSTKFSRREDPVPPQLLPGLPGCPGPCLLPCPQ

SEQ ID NO: 769154 - protein, 222 aa, Homo sapiens; identical to SEQ ID NO: 769143

SEQ ID NO: 769155 - protein, 222 aa, Homo sapiens; identical to SEQ ID NO: 769143

SEQ ID NO: 769156 - protein, 217 aa, Homo sapiens
MDAPSPLSILMQPLQGELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769157 - protein, 176 aa, Homo sapiens
FSPWPVQESRSVKMGRGLFQKLAERDRGAKIVALGDPGAFDGREGMRGDPDVTPSPIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 769158 - protein, 357 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQSLRLLRGDQRGCEKPFFTQPHAPCVSLSKELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVSLLFLPLGSCICAALVPSVGAISTSDTDCLP

SEQ ID NO: 769159 - protein, 114 aa, Homo sapiens
ILSCLVDVPWRTDRLNKQRVCKEAQSRREGSPAWLLVSTVTGWLCLSWLHCPEAGNMRKTSKGKTSPVGAMITLSARPGRGPKEMGSKSRDEKSKFLVSPWNSFPMPSFFVLLL

SEQ ID NO: 769160 - protein, 105 aa, Homo sapiens
KSSHVVNWTSRAGKAKPGLAKPTHLLQGVTVSLVCVCISTKEADTKGLRHTHTEQWENTDFGDRSNAQHPHLLAERPWESFLTPLSLFLLHVNRRSSNTQLARLI

SEQ ID NO: 769161 - protein, 965 aa, Homo sapiens
AVARERPRGPRAADGGDRGRRRARVSEAVASAPPHGRPQPLPQPSSLPLPFPPPPPRPPPSSLAGRARHGAASPPMALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769162 - protein, 877 aa, Homo sapiens
MALRRSMGRPGLPPLPLPPPPRLGLLLAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769163 - protein, 890 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769164 - protein, 1061 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQVRQNPPLSPLSWSISLQGSKAFKNFKMIVFGGPGSPAAPGNPFLLTLLCKLHFSKDYVSCWVASCVHFVNKAGSTFLLELGEGTDKALSPAQFAPIPHLCIPGLSLVCVLERPLQPGTGMYYSQKVVFLQPLNPQCPYTPMFPAGPFSVLRPQLEAFSPGSLWGGGFSWLQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769165 - protein, 842 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769166 - protein, 552 aa, Homo sapiens
MFPAGPFSVLRPQLEAFSPGSLWGGGFSWLQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769167 - protein, 424 aa, Homo sapiens
SNRDPRGSVICGNNSVRNHACDERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 769168 - protein, 170 aa, Homo sapiens [sequence omitted]

SEQ ID NO: 769169 - protein, 919 aa, Homo sapiens
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQVRQNPPLSPLSWSISLQGSKAFKNFKMIVFGGPGSPAAPGNPFLLTLLCKLHFSKDYVSCWVASCVHFVNKAGSTFLLELGEGTDKALSPAQFAPIPHLCIPGLSLVCVLERPLQPGTGMYYSQKVVFLQPLNPQCPYTPMFPAGPFSVLRPQLEAFSPGSLWGGGFSWLQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYMTVGTYSPPEGWLSSQGRQSTSQRVPSMRHRGFCCCSKGYCHTVAVSPQAEGIGAIWPALVATELAD

SEQ ID NO: 769170 - protein, 232 aa, Homo sapiens
GRPRYPAPRRADPPSPCSDAPAPPRSRLSRVLLLPQVQAEPAEPWPALPAAPKPLASPEAGMAVPGWGRRTSLPKRRGWGCSWRGEAHSPRTARTGRTRRYRAGRRPAPRQVATAKDSGRARGAMASPSSSSEGHWQAPRQGWQSQDGGGGRPSLKRRGWGPVAGRGEAAQPEDCEDGEEPALPGRKETGTQTGGDGKGVSDAGAGVRECRGLGGAGDATKGRREAPWPSPG

SEQ ID NO: 769171 - protein, 122 aa, Homo sapiens
NELKMVCCVGEIENVSKMKCHEDGRRPYVPIIPLLTKSLQEFTGDTVSLCVVLKSKSPVMLENKEEYTHTHTHTHTHTHTHTHTYVFVFVGLFFFCFFLVLLQAINFKRLKADRIVSLRKTN

SEQ ID NO: 769172 - protein, 858 aa, Homo sapiens
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELEPLQGKTLSFFSLAANSLYSRVSVDWGKCMNPFRNMVLEILDVSGNGWTVDITGNFSNAISKSQAFSLILAHHIMGAGFGFHNIKDPDQNTFAGLARSSVRHLDLSHGFVFSLNSRVFETLKDLKVLNLAYNKINKIADEAFYGLDNLQVLNLSYNLLGELYSSNFYGLPKVAYIDLQKNHIAIIQDQTFKFLEKLQTLDLRDNALTTIHFIPSIPDIFLSGNKLVTLPKINLTANLIHLSENRLENLDILYFLLRVPHLQILILNQNRFSSCSGDQTPSENPSLEQLFLGENMLQLAWETELCWDVFEGLSHLQVLYLNHNYLNSLPPGVFSHLTALRGLSLNSNRLTVLSHNDLPANLEILDISRNQLLAPNPDVFVSLSVLDITHNKFICECELSTFINWLNHTNVTIAGPPADIYCVYPDSFSGVSLFSLSTEGCDEEEVLKSLKFSLFIVCTVTLTLFLMTILTVTKFRGFCFICYKTAQRLVFKDHPQGTEPDMYKYDAYLCFSSKDFTWVQNALLKHLDTQYSDQNRFNLCFEERDFVPGENRIANIQDAIWNSRKIVCLVSRHFLRDGWCLEAFSYAQGRCLSDLNSALIMVVVGSLSQYQLMKHQSIRGFVQKQQYLRWPEDLQDVGWFLHKLSQQILKKEKEKKKDNNIPLQTVATIS

SEQ ID NO: 769173 - protein, 858 aa, Homo sapiens; identical to SEQ ID NO: 769172

SEQ ID NO: 769174 - protein, 79 aa, Homo sapiens
TGSGSQGGALQVTSWPTAPPWPCQPLTPQAVVGVGGRSAFRALPSCHCLSWPLIRACPLENKTKDVISQVPGPESQIQD

SEQ ID NO: 769175 - protein, 177 aa, Homo sapiens
MERNGRPRLVGRSPAADTGRDKGLGRFRSFLSCSPCKLFPPHGSLDESNKTGMEPDLTDGEAEASGSFPQHRRELLAFQQGVTGRKPGTWSNHLTLQMGNSWRYRKWQSTISALEVSPGAPAGWWGTQEPRPSPRVGCQFYGFPEYLTAEWMALVKAGLFPPTSTHKVSSWEAGKTV

SEQ ID NO: 769176 - protein, 132 aa, Homo sapiens
VTCYAAQNKVNTAFGWAANSCLNCDYCSFFYQKATLALWEWPSPVREKWKAKESPFQKSPSSLSPKYPFFRFSDGKQASTHSPHWGGECVGHSRPCLVKEKLNFSTCSSMFQKEQDCLCFEVHMKGSGTIAQ

SEQ ID NO: 769177 - protein, 175 aa, Homo sapiens
ELGAEPGARSRQSPAPVRWAPAPAVLPGCLRARPAMEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAIPGYKEQGIPQQL

SEQ ID NO: 769178 - protein, 126 aa, Homo sapiens
LFSGCVFSSSLSPLPPAASHSVLLQFPKSQATRSRASHSSCEPTGAAGEIQGGPVRAAPGSFGHKDLYMFFSAIFWTGGGKGVFLKILFILKTHLLFSAGCEGCQPLLLWKALWAQAPEHQRVGWR

SEQ ID NO: 769179 - protein, 154 aa, Homo sapiens
RPPELGAEPGARSRQSPAPVRWAPAPAVLPGCLRARPAMEPSHKDAETAAAAAAVAAADPRGASSSSGVVVQVREKKGPLRAAIPYMPFPVAVICLFLNTFVPGLGKTRLPRPLRPPPRRGRAWGERRARPETSWRGRALQVLRPRATARSWRP

SEQ ID NO: 769180 - protein, 266 aa, Homo sapiens
CDKAFNRFSYLTKHKIIHSGEKSYKCEQCGKGFNWSSTLTKHKRIHTGEKPYKCEECGKAFNVSSHLTTHKMIHTGEKPYKCEECGKAFNHSSKLTIHKIIHTGEKPYKCEECGKAFNQSSNLTKHKIIHTGEKLYKCEECGKAFNRSSNLTTHKRIHTGEKPYKCEECGKAFNRSSNLTKHNIIHTGEKSYKCEECGKAFNQSSTLTKHRKIQQGMVAHACNPNTLRGLGEQIARSGVQDQPGQHGKTPSLLEIQKFAGCGGRRL

SEQ ID NO: 769181 - protein, 107 aa, Homo sapiens
LSLGPRHQSKLKTQQWDSQTDGTMALSSQIWAACLLLLLLLASLTSGSVFPQQTGQLAELQPQDRAGARASWMPMFQRRRRRDTHFPICIFCCGCCHRSKCGMCCKT

SEQ ID NO: 769182 - protein, 686 aa, Homo sapiens
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 769183 - protein, 682 aa, Homo sapiens
EKDFAEGLSEKMSELEEDFAKILMLKEERIKELEKRLSEKEEEIQELKRKLHKCQSVLPVPSTHIGPRTTRAQGISAEPQTYRSFHDLRQAFRKFTKSERSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 769184 - protein, 323 aa, Homo sapiens
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGWTWNLFEYVVE

SEQ ID NO: 769185 - protein, 219 aa, Homo sapiens
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKKMESCYVAQLFLNSWAQEVLLP

SEQ ID NO: 769186 - protein, 217 aa, Homo sapiens
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 769187 - protein, 158 aa, Homo sapiens
MVKLGCSFSGKPGKDPGDQDGAAMDSVPLISPLDISQLQPPLPDQVVIKTQTEYQLSSPDQQNFPDLEGQRLNCSHPEEGRRVTTPTPPTVGTQDRRRRWKAAGGAWVPSRPVWGPLALREERVAVSHPAQSWPHRLPCTHQAPSRGCRCRLTKQWRS

SEQ ID NO: 769188 - protein, 270 aa, Homo sapiens
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRGLSSELEADLRCPEAMAPLQTVRSVPNRRSGRAWARGAQEGSAPPTLTRPLPQHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 769189 - protein, 135 aa, Homo sapiens
MAPLQTVRSVPNRRSGRAWARGAQEGSAPPTLTRPLPQHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 769190 - protein, 217 aa, Homo sapiens; identical to SEQ ID NO: 769186

SEQ ID NO: 769191 - protein, 127 aa, Homo sapiens
VSSPAARPGVGARRGAPAGSAQVSSWPPATASEPKTPATLPFLFPPTRPARTSGLGVANPSPPGDAGSAGSPWPRRRSQPSGSVSAASSASSCDQRVSRCSPPCSCPQAPSLQPRPRGSLTLSLFSK

SEQ ID NO: 769192 - protein, 199 aa, Homo sapiens
MENFRKVRSEEAPAGCGAEGGGPGSGPFADLAPGAVHMRVKEGSKIRNLMAFATASMAQPATRAIVFSGCGRATTKTVTCAEILKRRLAGLHQVTRLRYRSVREVWQSLPPGPTQGQTPGEPAASLSVLKNVPGLAILLSKDALDPRQPGYQPPNPHPGPSSPPAAPASKRSLGEPAAGEGSAKRSQPEPGVADEDQTA

SEQ ID NO: 769193 - protein, 199 aa, Homo sapiens; identical to SEQ ID NO: 769192

SEQ ID NO: 769194 - protein, 199 aa, Homo sapiens; identical to SEQ ID NO: 769192

SEQ ID NO: 769195 - protein, 199 aa, Homo sapiens; identical to SEQ ID NO: 769192

SEQ ID NO: 769196 - protein, 199 aa, Homo sapiens; identical to SEQ ID NO: 769192

SEQ ID NO: 769197 - protein, 241 aa, Homo sapiens
MPDWCHDNGAYSVSTLTIAHLRSESPPQCTTCQFRFTRARRRMENFRKVRSEEAPAGCGAEGGGPGSGPFADLAPGAVHMRVKEGSKIRNLMAFATASMAQPATRAIVFSGCGRATTKTVTCAEILKRRLAGLHQVTRLRYRSVREVWQSLPPGPTQGQTPGEPAASLSVLKNVPGLAILLSKDALDPRQPGYQPPNPHPGPSSPPAAPASKRSLGEPAAGEGSAKRSQPEPGVADEDQTA

SEQ ID NO: 769198 - protein, 203 aa, Homo sapiens
MAVSPIFFLTTRLCRDSSRLAPCVSPPLQPCVLSLWSLQGQAQRLNSFKMVQGTAQSLASSSLLPHSASRAGPGLRGCCKWGPVYPCTSPLRERERHIVFLGGEGRSGRTASMNSPGGHCKGWQTLLRSLNLQPPDNKLNLTQKAGTKPPALWVGSPLHCPLSQKGQHTLGKGGGERLSTNPLLEITIQQRSWVLGCESLQAS

SEQ ID NO: 769199 - protein, 106 aa, Homo sapiens [sequence omitted]

SEQ ID NO: 769200 - protein, 199 aa, Homo sapiens; identical to SEQ ID NO: 769192

SEQ ID NO: 769201 - protein, 199 aa, Homo sapiens; identical to SEQ ID NO: 769192

SEQ ID NO: 769202 - protein, 199 aa, Homo sapiens; identical to SEQ ID NO: 769192

SEQ ID NO: 769203 - protein, 199 aa, Homo sapiens; identical to SEQ ID NO: 769192

SEQ ID NO: 769204 - protein, 203 aa, Homo sapiens
AGLRLRSPKDEAAPGFRSAGRPKGTAPRAAHAARARSADTPGMLAPQRTRAPSPRAAPRPTRSMLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 769205 - protein, 202 aa, Homo sapiens
AAFQYPPSPEVQYGSQAVRPVPNSKALYQQPTAMAFDLTVPPSGQDSALHETIATARKQGDLEAWQYPVMLQPMPAGKGSQAGVKQYGPNSPYMRTLLNSIAHGNRLISYDWEILAKSSLSPSQYLQFKTWWIDGVQEQVRKNQATNPVAYIDEDQLLGRGPNWDTINQQSVMKMRLLNNYKGYLPQGLGKHSGPRNLMPFF

SEQ ID NO: 769206 - protein, 121 aa, Homo sapiens
SLLKNVASSYSCDEVGEPSPLPGTVSQITPQDSGPDGKPAALQPPNGEGTHHMGMLPQHREVPIIWRCSHCTDTPIAQILPQHREVPIIWGCSHCTDTPIAQILPPHREAPMIWGCSHCTD

SEQ ID NO: 769207 - protein, 73 aa, Homo sapiens
MPSQTHATHEYKAHALSILAHLLLTLQACGDLPPPRPRGGKPRRWEEAQVPLRVPECVCLCMCVSNPTPGSTS

SEQ ID NO: 769208 - protein, 199 aa, Homo sapiens
MTVGLLPPPEKLTAEVLGIICIVLMATVLKTIVLIPFLEQNNSSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKLCKAKHLRLTEIKILLYLSKQNFIVGQS

SEQ ID NO: 769209 - protein, 231 aa, Homo sapiens [sequence omitted]

SEQ ID NO: 769210 - protein, 39 aa, Homo sapiens
MVSVSLNILFPQTLRVEGPAQGICIPLHVIYKPAALAAS

SEQ ID NO: 769211 - protein, 80 aa, Homo sapiens
RLTRREELLCQNPLHRLRYLHHFQVHPFFRGVAFDPELLQKQPVNFVTETQATQPSSAETMPFDDFDCDLESFLLYPIPA

SEQ ID NO: 769212 - protein, 209 aa, Homo sapiens
MGFCRLEEAGLVSRSIRERNCLYNWDSRFSRERRQRLGMGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQVISMTWASCIEM

SEQ ID NO: 769213 - protein, 312 aa, Homo sapiens
MGFCRLEEAGLVSRSIRERNCLYNWDSRFSRERRQRLGMGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQRQINHPFVHSLGDSWQGKRHLFIMCSYCSTDLYSLWSAVGCFPEASIRLFAAELVLVLCYLHDLGIMHRDVKMENILLDERGHLKLTDFGLSRHVPQGAQAYTICGTLQYMGERG

SEQ ID NO: 769214 - protein, 285 aa, Homo sapiens
MGFCRLEEAGLVSRSIRERNCLYNWDSRFSRERRQRLGMGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQRQINHPFVHSLGDSWQGKRHLFIMCSYCSTDLYSLWSAVGCFPEASIRLFAAELVLVLCYLHDLGIMHRDVKMENILLDERDTKISWS

SEQ ID NO: 769215 - protein, 222 aa, Homo sapiens
MGFCRLEEAGLVSRSIRERNCLYNWDSRFSRERRQRLGMGAVSCRQGQHTQQGEHTRVAVPHKQGGNIRGPWARGWKSLWTGLGTIRSDLEELWELRGHHYLHQESLKPAPVLVEKPLPEWPVPQFINLFLPEFPIRPIRGQQQLKILGLVAKGSFGTVLKVLDCTQKAVFAVKVVPKVKVLQRDTVRQCKEEVSIQRQINHPFVHSLGDSWQGKRHLFISE

SEQ ID NO: 769216 - protein, 222 aa, Homo sapiens; identical to SEQ ID NO: 769215

SEQ ID NO: 769217 - protein, 209 aa, Homo sapiens; identical to SEQ ID NO: 769212

SEQ ID NO: 769218 - protein, 529 aa, Homo sapiens
DTLFGRGFPRPRSGLDTRGGSIYARRAADACPVTRTARPARGGGGGRRLVTVTPILDLPLGGWGDPGFNWRLFWGTPDAMLWKITDNVKYEEDCEDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSGLEAGAVSARRDAYRRSDLLLPHAHALDAAGLAENLGLHDMPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 769219 - protein, 529 aa, Homo sapiens; identical to SEQ ID NO: 769218

SEQ ID NO: 769220 - protein, 114 aa, Homo sapiens
GRLPAAEEKGRLWAAAGRGGVARSAGWAPHLPAPKPIDAAATAAAERRLPRARGCARPMQDATEEARSKAKQNKFLQPCRLSPTHSSERMDTSYQPLTFVSVRIIIGMVLPGTI

SEQ ID NO: 769221 - protein, 190 aa, Homo sapiens
MHCNVGLERPHVREAPSTLITRKRPLPTVKAQMGLQASLEAETFVTLGTRKGLLSRVNSDVLVQLNLVDEFPATFTTRKRLFLAVRPLVGLQGSLPGEAPATLGTVEGPLPAVLGQMDLHAPLQAEAPVTLRTLEGLLSAVQPQVLRELALLHEGPPHSPQQNGRSPRCRHRCFFRLALYRKVLSHSGHG

SEQ ID NO: 769222 - protein, 449 aa, Homo sapiens
MHCNVGLERPHVREAPSTLITRKRPLPTVKAQMGLQASLLEEAFATLGTLEGPLSTVLIQVDLQAAPDAVALVTLRTLEGLLPAVDSNVFCEPVLLSETFAAHHTREWLLATVLQQVAFQISLEAESLLAFRTLVGLLSTVQPQVLGELRLMRVGLVTLTAREGLLVPVHPLVELHGGLPGEALVALGTLEGLLATVKPRVLCEMRASAETAAALGAGERLFRGVDLQVLREPRLLRKGLFALAAGKLLLPVVDSGVAGELGRPREALAALGAGEGLLLAVQALVGAHGVPPEEAPAALRALEGPLPNVLQPVGFQASLEAETFVTLGTRKGLLSRVNSDVLVQLNLVDEFPATFTTRKRLFLAVRPLVGLQGSLPGEAPATLGTVEGPLPAVLGQMDLHAPLQAEAPVTLRTLEGLLSAVQPQVLRELALLHEGPAALPAAERPLPAV

SEQ ID NO: 769223 - protein, 82 aa, Homo sapiens
SGELLASPGSSKLLQEGPSQTRRHADHHHSPGVLAASWDVAGRCGQQEHAGTLLQMLLLICGARDSPEGNPVLQKYQLHLLQ

SEQ ID NO: 769224 - protein, 173 aa, Homo sapiens
KQVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYL

SEQ ID NO: 769225 - protein, 67 aa, Homo sapiens
PAKMSCQQNQQQCQPPPSCPSPKCPPKSPAQCLPPPSSDCALSSGGCGPSSESGCCLSHHRHFRSHQ

SEQ ID NO: 769226 - protein, 1456 aa, Homo sapiens
KSGGPGTREREREKREERQSAWGRKERGREGWVRRRERSAANPRRRAWSPSQNSSPSRSRSQGGGCRDRQPCMMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 769227 - protein, 1044 aa, Homo sapiens
MRLHFCPKGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 769228 - protein, 780 aa, Homo sapiens
MPNSSQSSVPSCLPENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 769229 - protein, 1044 aa, Homo sapiens; identical to SEQ ID NO: 769227

SEQ ID NO: 769230 - protein, 974 aa, Homo sapiens
MRLHFCPKGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMGKLRVRTRFRQGAVAYVPGSELPLFFFSVLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 769231 - protein, 897 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 769232 - protein, 114 aa, Homo sapiens
GREREGDEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEINCKY

SEQ ID NO: 769233 - protein, 897 aa, Homo sapiens; identical to SEQ ID NO: 769231

SEQ ID NO: 769234 - protein, 876 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHKRLACKIFLILRWFGKKRREENCLGTRVRNVKFIMQICQQKKEKRNWLPAQDTDSATFHPTHQRIFGKLVFLPLRLVWKEVILRKILILVLVQKDVSLTTQYFLQKARSRRHRR

SEQ ID NO: 769235 - protein, 897 aa, Homo sapiens; identical to SEQ ID NO: 769231

SEQ ID NO: 769236 - protein, 897 aa, Homo sapiens; identical to SEQ ID NO: 769231

SEQ ID NO: 769237 - protein, 912 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKGPQLAKPCKYQCLRNCPLFPNSTSGPFSLPLGALLCWPFSPGF

SEQ ID NO: 769238 - protein, 894 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIHIYYADIQAEEREKNGFCKNDSVMHQNRDWSGSFNQLYGRVIRRLTACQRVLKNFQRGEIIDEEEGSLFIRESLVE

SEQ ID NO: 769239 - protein, 416 aa, Homo sapiens
THASPTRRPTRRSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 769240 - protein, 89 aa, Homo sapiens
SGRDVARAPGRGGSGRLRARPAAPGLKARAVRRGRLSHRGFGTLVREKGEREKRAAVLSQPQKVLASLRGLSRIPRQSRRRYLTCPKTT

SEQ ID NO: 769241 - protein, 897 aa, Homo sapiens; identical to SEQ ID NO: 769231

SEQ ID NO: 769242 - protein, 109 aa, Homo sapiens
GTVVHTNERDSGMLTSYATPDTATRYEQQCTAELECEEDVIPDSPITAFSFSGVNRLRRKENPRYSDQDEQQCRYEQQCRYEQQCRYEQQCRYEQQCRYEQQCRYEQQC

SEQ ID NO: 769243 - protein, 880 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMATTVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 769244 - protein, 897 aa, Homo sapiens; identical to SEQ ID NO: 769231

SEQ ID NO: 769245 - protein, 866 aa, Homo sapiens
LGLSLPASDKVSELKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 769246 - protein, 836 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEILLTYVIYHQPHESAIHGH

SEQ ID NO: 769247 - protein, 341 aa, Homo sapiens
LLLLNSRPRRRSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 769248 - protein, 810 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPALFMSSKTFQSPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEILLTYVIYHQPHESAIHGH

SEQ ID NO: 769249 - protein, 380 aa, Homo sapiens
MASLAAANAEFCFNLFREMDDNQGNGNVFFSSLSLFAALALVRLGAQDDSLSQIDKLLHVNTASGYGNSSNSQSGLQSQLKRVFSDINASHKDYDLSIVNGLFAEKVYGFHKDYIECAEKLYDAKVERVDFTNHLEDTRRNINKWVENETHGKIKNVIGEGGISSSAVMVLVNAVYFKGKWQSAFTKSETINCHFKSPKCSGKAVAMMHQERKFNLSVIEDPSMKILELRYNGGINMYVLLPENDLSEIENKLTFQNLMEWTNPRRMTSKYVEVFFPQFKIEKNYEMKQYLRALGLKDIFDESKADLSGIASGGRLYISRMMHKSYIEVTEEGTEATAATGSNIVEKQLPQSTLFRADHPFLFVIRKDDIILFSGKVSCP

SEQ ID NO: 769250 - protein, 380 aa, Homo sapiens; identical to SEQ ID NO: 769249

SEQ ID NO: 769251 - protein, 78 aa, Homo sapiens
PPHLGAGDPSAGLWTSSSRQGRRRSWSRSGDRGFPGVAMEGSPRCMLHITEGGRDTACPSLGQRLMRRTCKWGDGVSH

SEQ ID NO: 769252 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 769253 - protein, 750 aa, Homo sapiens; identical to SEQ ID NO: 769252

SEQ ID NO: 769254 - protein, 688 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKNMLIGVELQRLLVFQVFLFIQIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 769255 - protein, 657 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKNMLIGVELQRLLVFQVFLFIQIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 769256 - protein, 507 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKNMLIGVELQRLLVFQVFLFIQIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFNFHF

SEQ ID NO: 769257 - protein, 420 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKNMLIGVELQRLLVFQVFLFIQIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKEVL

SEQ ID NO: 769258 - protein, 277 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANGE

SEQ ID NO: 769259 - protein, 107 aa, Homo sapiens
HACGQVPSDENSPRNRPTRSHVPSNENSLRNRPTRGQVPSDENNPRNRTPRGQVPSDENNPRNRTPRGQVPSDENDPRNHPTRSHVPSNDNNPRNHPTHGHIPSDEN

SEQ ID NO: 769260 - protein, 78 aa, Homo sapiens
TLSRAGPGPGRGAGTSARRCSPGPLGFSHLGIWGQWRSARSASNLCSGQRKPDSRIRWCHRQLLNANFVPALSEQDSS

SEQ ID NO: 769261 - protein, 258 aa, Homo sapiens [sequence omitted]

SEQ ID NO: 769262 - protein, 258 aa, Homo sapiens [sequence omitted]

SEQ ID NO: 769263 - protein, 141 aa, Homo sapiens
MGTRDDVPEAKVLVPVAVYCGSIPRTSAGPRVLPPGSINSSLPHGEGSLQPEPRALLNNEEPSQLLRGLGQLGGLKLDTPSKGWQARNGHPRNLRALSLGDQPLVLLPSPESEANSVARDTIQIKDKLKKRRLSEGLAASS

SEQ ID NO: 769264 - protein, 44 aa, Homo sapiens
SPSQLPALNTTGNGLPADLTHHLHHPSQQQLCSPAHPSQQQLCS

SEQ ID NO: 769265 - protein, 74 aa, Homo sapiens
GPAQIPQLRCSGTQGEKGDQVSWRGLMCGTRSRSRSPGEDLVPVKLAAPGGLSACFCSHCVSCLQASPLAFALP

SEQ ID NO: 769266 - protein, 474 aa, Homo sapiens
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 769267 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 769268 - protein, 967 aa, Homo sapiens; identical to SEQ ID NO: 769267

SEQ ID NO: 769269 - protein, 570 aa, Homo sapiens [sequence omitted]

SEQ ID NO: 769270 - protein, 577 aa, Homo sapiens
MIHTLMWVLDCFLGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 769271 - protein, 577 aa, Homo sapiens
GIHRYPLNDANADIRMPALNYCCDNVSMLNDCTRIPTGVVVMVSPAETTNSAVYCYNPYVITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 769272 - protein, 570 aa, Homo sapiens [sequence omitted]

SEQ ID NO: 769273 - protein, 967 aa, Homo sapiens; identical to SEQ ID NO: 769267

SEQ ID NO: 769274 - protein, 967 aa, Homo sapiens; identical to SEQ ID NO: 769267

SEQ ID NO: 769275 - protein, 967 aa, Homo sapiens; identical to SEQ ID NO: 769267

SEQ ID NO: 769276 - protein, 821 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSSWSNSRILVNVCSALL

SEQ ID NO: 769277 - protein, 138 aa, Homo sapiens
MKALLKREHLCCLVIFCTCSQTLKPVMSMAAWALNVYMIPAAFLLSQTMFINAFWYINSTSSSVTTVYVYFIFQEYPATGAQPLPLVPPGDLVNSSMSPQHCVIWHNKCSWAVVVVTPPKTTQEFNTVWPPVTDIAAP

SEQ ID NO: 769278 - protein, 153 aa, Homo sapiens
MYLCHASSQHPIVTVFACLSPLLHPHVPMPMRPQRARTVACSFALCLALSRDSVNECGMWFTQPGRMGYQPGQEQSTGWGRIQDKEVSSPSSGHSSSGDWEEGRFVYAVFLWLITVQTGHLPPATLTSGLVEPQGTFAGQPNFGPGPGAGPGS

SEQ ID NO: 769279 - protein, 807 aa, Homo sapiens
ARWLSRKMAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGAGAPGEVDSAGAEVTSALLSRVTASAPGPAAPDPPGTGASGATVVSGSASGPAAPGKVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 769280 - protein, 783 aa, Homo sapiens
ARWLSRKMAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGAGAPGEVDSAGAEVTSALLSRVTASAPGPAAPDPPGTGASGATVVSGSASGPAAPGKVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTK

SEQ ID NO: 769281 - protein, 813 aa, Homo sapiens
ARWLSRKMAALAEEQTEVAVKLEPEGPPTLLPPQAGDGAGEGSGGTTNNGPNGGGGNVAASSSTGGDGGTPKPTVAVSAAAPAGAAPVPAAAPDAGAPHDRQTLLAVLQFLRQSKLREAEEALRREAGLLEEAVAGAGAPGEVDSAGAEVTSALLSRVTASAPGPAAPDPPGTGASGATVVSGSASGPAAPGKGEPWGPVGSVAVEDQPDVSAVLSAYNQQGDPTMYEEYYSGLKHFIECSLDCHRAELSQLFYPLFVHMYLELVYNQHENEAKSFFEKFHGDQECYYQDDLRVLSSLTKKEHMKGNETMLDFRTSKFVLRISRDSYQLLKRHLQEKQNNQIWNIVQEHLYIDIFDGMPRSKQQIDAMVGSLAGEAKREANKSKVFFGLLKEPEIEVPLDDEDEEGENEEGKPKKKKPKKDSIGSKSKKQDPNAPPQNRIPLPELKDSDKLDKIMNMKETTKRVRLGPDCLPSICFYTFLNAYQGLTAVDVTDDSSLIAGGFADSTVRVWSVTPKKLRSVKQASDLSLIDKESDDVLERIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 769282 - protein, 147 aa, Homo sapiens
AKTLAERTAGQERLAPLLPRILSDADPDTTWNSFSRTFLRVLWARAQLSPLSVALFFACLRDSAVGPPSARASPATQRPPRAQERGIAASSRGSPEARSFGGAPFESRNFLTCPLCQHVQQTSCCYCCRCCCCKGRNKPSTYPPPRW

SEQ ID NO: 769283 - protein, 690 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 769284 - protein, 704 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769285 - protein, 646 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769286 - protein, 646 aa, Homo sapiens; identical to SEQ ID NO: 769285

SEQ ID NO: 769287 - protein, 318 aa, Homo sapiens
MDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769288 - protein, 772 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCTFHITTRPSRIHRPIPGFPVLVFRSIVVEKETLALDAHVGCPGCSNSHRAVRARSGQSFSMRAFLESVHRPPSRSWHHTHAGDKQNHFLPLYLLKQQKYKNTAVGSLL

SEQ ID NO: 769289 - protein, 659 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEPSILQPVPAVFIGLFLAFLFWCFGPLW

SEQ ID NO: 769290 - protein, 646 aa, Homo sapiens; identical to SEQ ID NO: 769285

SEQ ID NO: 769291 - protein, 136 aa, Homo sapiens
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEAR

SEQ ID NO: 769292 - protein, 642 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHKYARTTLFFRYKYFTGANVQPISVWLFGRLTILNKYFSFFFSCHHHYPTCPFLVLMEYRFIKCPKETL

SEQ ID NO: 769293 - protein, 389 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKGTLTCFYDIVNQGIKSPFAIKSVLDIM

SEQ ID NO: 769294 - protein, 646 aa, Homo sapiens; identical to SEQ ID NO: 769285

SEQ ID NO: 769295 - protein, 687 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769296 - protein, 663 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769297 - protein, 294 aa, Homo sapiens
MDYSFILMGQENDGYTFAAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNPSILQPVPAVFIGLFLAFLFWCFGPLW

SEQ ID NO: 769298 - protein, 646 aa, Homo sapiens; identical to SEQ ID NO: 769285

SEQ ID NO: 769299 - protein, 418 aa, Homo sapiens
VSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAATVPPAV

SEQ ID NO: 769300 - protein, 704 aa, Homo sapiens; identical to SEQ ID NO: 769284

SEQ ID NO: 769301 - protein, 934 aa, Homo sapiens [sequence omitted]

SEQ ID NO: 769302 - protein, 221 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKGKCFYPRERKKTGLGKTLGGKTWN

SEQ ID NO: 769303 - protein, 725 aa, Homo sapiens
MGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 769304 - protein, 133 aa, Homo sapiens [sequence omitted]

SEQ ID NO: 769305 - protein, 794 aa, Homo sapiens
MSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 769306 - protein, 57 aa, Homo sapiens
GKAARFGLSPPCSGERKGSNTGQTEPQSGGGPQIPAPVHSESHTDPAAGRLAPTSCQ

SEQ ID NO: 769307 - protein, 171 aa, Homo sapiens
MSSNECFKCGRSGHWARECPTGGGRGRGMRSRGRGFQFVSSSLPDICYRCGESGHLAKDCDLQEDEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 769308 - protein, 118 aa, Homo sapiens
MSYWWRPWSWNEKPWQRLVLPRIEVSSLFPRLFQIFVIAVVSLVILPRIVIFRRMKPAITAVEVATLPRTARSPRESESNAATTVANQAIWLVTATMQMSRNAILVENSDTFKKTAPK

SEQ ID NO: 769309 - protein, 171 aa, Homo sapiens; identical to SEQ ID NO: 769307

SEQ ID NO: 769310 - protein, 171 aa, Homo sapiens; identical to SEQ ID NO: 769307

SEQ ID NO: 769311 - protein, 118 aa, Homo sapiens; identical to SEQ ID NO: 769308

SEQ ID NO: 769312 - protein, 118 aa, Homo sapiens; identical to SEQ ID NO: 769308

SEQ ID NO: 769313 - protein, 118 aa, Homo sapiens; identical to SEQ ID NO: 769308

SEQ ID NO: 769314 - protein, 118 aa, Homo sapiens; identical to SEQ ID NO: 769308

SEQ ID NO: 769315 - protein, 118 aa, Homo sapiens; identical to SEQ ID NO: 769308

SEQ ID NO: 769316 - protein, 118 aa, Homo sapiens; identical to SEQ ID NO: 769308

SEQ ID NO: 769317 - protein, 78 aa, Homo sapiens
LGLDCRTPRADWPRGRGGGEPCAAAYVGPCADPRVAQARTLKINSLYLASRLPQACVRVSAAAGPLRRGRSDCSHEQQ

SEQ ID NO: 769318 - protein, 142 aa, Homo sapiens
MSYWWRPWSWNEKPWQRCYRCGESGHLAKDCDLQEDEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 769319 - protein, 126 aa, Homo sapiens
MCYRCGESGHLAKDCDLQEDEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 769320 - protein, 118 aa, Homo sapiens; identical to SEQ ID NO: 769308

SEQ ID NO: 769321 - protein, 78 aa, Homo sapiens; identical to SEQ ID NO: 769317

SEQ ID NO: 769322 - protein, 171 aa, Homo sapiens; identical to SEQ ID NO: 769307

SEQ ID NO: 769323 - protein, 49 aa, Homo sapiens
MSSNECFKCGRSGHWARECPTGGGRGRGMRSRGRGQGRRGREFSSSRRP

SEQ ID NO: 769324 - protein, 171 aa, Homo sapiens; identical to SEQ ID NO: 769307

SEQ ID NO: 769325 - protein, 118 aa, Homo sapiens; identical to SEQ ID NO: 769308

SEQ ID NO: 769326 - protein, 118 aa, Homo sapiens; identical to SEQ ID NO: 769308

SEQ ID NO: 769327 - protein, 118 aa, Homo sapiens; identical to SEQ ID NO: 769308

SEQ ID NO: 769328 - protein, 118 aa, Homo sapiens; identical to SEQ ID NO: 769308

SEQ ID NO: 769329 - protein, 78 aa, Homo sapiens; identical to SEQ ID NO: 769317

SEQ ID NO: 769330 - protein, 118 aa, Homo sapiens; identical to SEQ ID NO: 769308

SEQ ID NO: 769331 - protein, 96 aa, Homo sapiens
QQHRVLLWGHAQLVVEGVVPDLLHVIPDGDDAMLDRVLQGQDVVLALGLMAHVGVLLAHAHHHTLVPGSPDDGGEHSSGAIHPQQSQLCTCQSHCQ

SEQ ID NO: 769332 - protein, 94 aa, Homo sapiens
GGLRWNPNLRGGTEVSGTLTDSLGSQELSGSSPKRRRAEDKDEGIGSPDIWEDEKAEDLRREMIELRQQLDKERSVRMMLEEQPCQHSTNPRYR

SEQ ID NO: 769333 - protein, 140 aa, Homo sapiens
MPLHSSLGDIARACLQKKSKRSLFFLYSSGPPLLLCQAFFWAMCFGGDSGWLRAPTVSWLAMYPRPSLLSGSSLLQAIQHIEGTQEKQELEEEQRRAVIVKPVRSCPEAPTSDTASDSEASDSDAMDQSREEPSGDGELP

SEQ ID NO: 769334 - protein, 338 aa, Homo sapiens
MEYFMVPTQKVPSLQHFRKTEKEVIGGLCSLANIPLTPETQRDQERRIRREIANSNERRRMQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQVRSLEAHMYPEKLKVIAQQVQLQQQQEQVRLLHQEKLEREQQQLRTQLLPPPAPTHHPTVIVPAPPPPPSHHINVVTMGPSSVINSVSTSRQNLDTIVQAIQHIEGTQEKQELEEEQRRAVIVKPVRSCPEAPTSDTASDSEASDSDAMDQSREEPSGDGELP

SEQ ID NO: 769335 - protein, 338 aa, Homo sapiens; identical to SEQ ID NO: 769334

SEQ ID NO: 769336 - protein, 745 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769337 - protein, 745 aa, Homo sapiens; identical to SEQ ID NO: 769336

SEQ ID NO: 769338 - protein, 787 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRKSVFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769339 - protein, 729 aa, Homo sapiens
MPAVGTRQTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769340 - protein, 516 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPPTFTPAQRFPLLLSPTGGKGRGGWMGGQGSPSVLRLHRVFRLNQEIFYYQKEKRKKKSQRPPFLPAPLGQSRLDLWGFPGGWLRAGTLSGKSGGAPVRPSARPTVGFSPLLPPSPPSKPPEVAFP

SEQ ID NO: 769341 - protein, 132 aa, Homo sapiens
MWGCSSAEVAELRRIMLDLLLGLESRCPKVGIIRRWAGVKSVLPVPCSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769342 - protein, 129 aa, Homo sapiens
RDARLCPLHRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769343 - protein, 504 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDR

SEQ ID NO: 769344 - protein, 147 aa, Homo sapiens
LRRRQSPDLAPPPATAALGARSGRETWITAGFGALASTATFARIAYGQKPVSAEERTPESGAPAPVARLRDPKTWRDEGRPMSSCRHRRRFCVCAARRLVGNLRVTPHSPLPRDSPFSSPLLEAKEGEGGWGGRAPPRYCGCTEYFA

SEQ ID NO: 769345 - protein, 470 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPARPARGLAAPSADQPGS

SEQ ID NO: 769346 - protein, 387 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELKAGVSGDGVAFQLGALVAQ

SEQ ID NO: 769347 - protein, 137 aa, Homo sapiens
LQRGYRFCGDLGNTTKFQSWFSHLLVVWLWASHFPSLASVEWGLAGLLASPVGNEHAWGWHSVDPLALPIPILPLAQQLVLPFPPLILTLRRLRVTTQKISGLRRTGSQGGKPAAQPRCLPAPCPVWRGRRPPQPPP

SEQ ID NO: 769348 - protein, 226 aa, Homo sapiens
HTAGAFFTSSIKGDSKVKMTLSHHTSQRPESRKKKMVILLTLPSLTVASENMVPSLTVHGSIRKSDGSALRCSKENLGPHHHQALSWCEISSSRAMLLGFSPTINNSSLLTDHMISPTLDNIPQHLVFPLPHPIKKEARLSPLLTRSNKAGRHVGVRGKDRTQQSQEGLALWLWSPLQEARRFPQQCILPVVSSPEFLTQSSNGVNFLPHLLILKKHFSVVITTPT

SEQ ID NO: 769349 - protein, 745 aa, Homo sapiens; identical to SEQ ID NO: 769336

SEQ ID NO: 769350 - protein, 691 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769351 - protein, 787 aa, Homo sapiens; identical to SEQ ID NO: 769338

SEQ ID NO: 769352 - protein, 787 aa, Homo sapiens; identical to SEQ ID NO: 769338

SEQ ID NO: 769353 - protein, 724 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769354 - protein, 778 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769355 - protein, 865 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASGGPAGRAAGRCAAPPGRDCSDGLVCLPCWHFSPPWPFSVFSYMFVGGGRLFSSPPHSPLPRDSPFSSPLLEAKEGEGGWGGRAPPRYCGCTEYFA

SEQ ID NO: 769356 - protein, 852 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASGGPAGRAAGRCAAPPGRDCSDGLVCLPCWHFSPPWPFSVFSPHSPLPRDSPFSSPLLEAKEGEGGWGGRAPPRYCGCTEYFA

SEQ ID NO: 769357 - protein, 764 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769358 - protein, 146 aa, Homo sapiens
IFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769359 - protein, 182 aa, Homo sapiens
PTQLVPSSPVQEKEIQKSDDTFTPHITKTRIKEEENGHPSHSSLTHSGLGKHGPQSHSSWVNQEKRLICSEMLKGKSGSSPSSGAELVVKSVLPVPCSMEPNEMMREIRKVLDANSCQSELHEKYMLLCMHGTPGHEDFVQWEMEVCKLPRLSLNGVRFKRISGTSMAFKNIASKIANELKL

SEQ ID NO: 769360 - protein, 269 aa, Homo sapiens
EDPEEVGHGELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPPTFTPAQRFPLLLSPTGGKGRGGWMGGQGSPSVLRLHRVFRLNQEIFYYQKEKRKKKSQRPPFLPAPLGQSRLDLWGFPGGWLRAGTLSGKSGGAPVRPSARPTVGFSPLLPPSPPSKPPEVAFP

SEQ ID NO: 769361 - protein, 398 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPKQCTGIL

SEQ ID NO: 769362 - protein, 316 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLELRVACCNLMVSNEINTCRMF

SEQ ID NO: 769363 - protein, 234 aa, Homo sapiens
RAGGGGGHVGSSRSGGGCLCAGRGAVPLRAGEERGRRPAAAAESRRSGAARPKGGTAQPGVGGVRSGAARSRRGLARAAHPRAGVSGCPASPHPRPGPMRRVLLLEKPRPAGLRAFPSLPSSKLLGSLPRDTGAMSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFRD

SEQ ID NO: 769364 - protein, 91 aa, Homo sapiens
TTTITITTTTITITITTALCLLGSPHTKVFNRLQPKSSHKATTDQIVPEKHLATTLQSPAVHGTGGNRKLETGNRSATLVSCCEDNISKCA

SEQ ID NO: 769365 - protein, 714 aa, Homo sapiens
ERQAGTVWDVWASGLACGTQLPLYWGVTEWPGSRDMAAASAVSVLLVAAERNRWHRLPSLLLPPRTWVWRQRTMKYTTATADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 769366 - protein, 567 aa, Homo sapiens
MKHIPSAPLPPSRATYLWRKSFKWPRPLLHRLSIQDAVFFQKTWNLLNFVSKKELGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 769367 - protein, 566 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNSFRLLG

SEQ ID NO: 769368 - protein, 662 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVIT

SEQ ID NO: 769369 - protein, 161 aa, Homo sapiens
NVIYPGRGLLAWAIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 769370 - protein, 502 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLAPNGFLSTVGPNLNWNVPGFPQPNVLPRRGKVFGAVFPG

SEQ ID NO: 769371 - protein, 110 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMGVAGTTGADHQAQLILARY

SEQ ID NO: 769372 - protein, 104 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMVVCVKNWKPRLTF

SEQ ID NO: 769373 - protein, 725 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 769374 - protein, 652 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLPTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQEIPMRPGLQ

SEQ ID NO: 769375 - protein, 219 aa, Homo sapiens
TSRIPAVRTILKDKAMTDTFTVQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 769376 - protein, 148 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQRLIGGRDLPCLRRDVGLWTFELMLK

SEQ ID NO: 769377 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 769378 - protein, 1530 aa, Homo sapiens
MYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 769379 - protein, 758 aa, Homo sapiens
MTWNVPSVLLFQDSKTRLLIRHLSLLFFGVCFQILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 769380 - protein, 988 aa, Homo sapiens
MVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 769381 - protein, 751 aa, Homo sapiens
MDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 769382 - protein, 640 aa, Homo sapiens
MIDMLYFVVIMLVVLMSFGVARQAILHPEEKPSWKLARNIFYMPYWMIYGEVFADQIDRKSRIHTPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 769383 - protein, 306 aa, Homo sapiens
MTWNVPSVLLFQDSKTRLLIRHLSLLFFGVCFQILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLSMCRALHF

SEQ ID NO: 769384 - protein, 339 aa, Homo sapiens
MYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPVKLFFFDSYH

SEQ ID NO: 769385 - protein, 610 aa, Homo sapiens
LLIMVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPVATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQLVESADVEPAYMKG

SEQ ID NO: 769386 - protein, 67 aa, Homo sapiens
MEDLFSPSILPPAPNISVPILLGWGLNLTLGQGAPASGPPSRRVRLVFLGVILVVAVAGNTTVLCRL

SEQ ID NO: 769387 - protein, 59 aa, Homo sapiens
MWRPRGAVFRVVSAAWRPPGQTSAIAFPGGPQAICVSPQAPPALAQYSDLGLPGVGGEP

SEQ ID NO: 769388 - protein, 1287 aa, Homo sapiens
MVPGEENQLVPKEHHWIITSDKSLLDANFEPGKKNFLHLTDKDGEQPQILLEDSSAGEDSVHDRFIGPLPREGSVGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMAHSGSAAGGHYYACIKSFSDEQWYSFDDQHVSRITQEDIKKTHGGSSGSRGYYSSAFASSTNAYMLIYRLKDPARNAKFLEVGEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 769389 - protein, 1207 aa, Homo sapiens
MVPGEENQLVPKEIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSVGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMAHSGSAAGGHYYACIKSFSDEQWYSFDDQHVSRITQEDIKKTHGGSSGSRGYYSSAFASSTNAYMLIYRLKDPARNAKFLEVGEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGCFRSNSTINLNG

SEQ ID NO: 769390 - protein, 1355 aa, Homo sapiens
MVPGEENQLVPKEIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSVGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMAHSGSAAGGHYYACIKSFSDEQWYSFDDQHVSRITQEDIKKTHGGSSGSRGYYSSAFASSTNAYMLIYRLKDPARNAKFLEVGEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 769391 - protein, 281 aa, Homo sapiens
VYDDNSVMLHTPECAVGKPTWRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 769392 - protein, 1355 aa, Homo sapiens; identical to SEQ ID NO: 769390

SEQ ID NO: 769393 - protein, 1355 aa, Homo sapiens; identical to SEQ ID NO: 769390

SEQ ID NO: 769394 - protein, 1297 aa, Homo sapiens
MVPGEENQLVPKEIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSVGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMAHSGSAAGGHYYACIKSFSDEQWYSFDDQHVSRITQEDIKKTHGGSSGSRGYYSSAFASSTNAYMLIYRLKDPARNAKFLEVGEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGIKQKN

SEQ ID NO: 769395 - protein, 1355 aa, Homo sapiens; identical to SEQ ID NO: 769390

SEQ ID NO: 769396 - protein, 1355 aa, Homo sapiens; identical to SEQ ID NO: 769390

SEQ ID NO: 769397 - protein, 1355 aa, Homo sapiens; identical to SEQ ID NO: 769390

SEQ ID NO: 769398 - protein, 1355 aa, Homo sapiens; identical to SEQ ID NO: 769390

SEQ ID NO: 769399 - protein, 1355 aa, Homo sapiens; identical to SEQ ID NO: 769390

SEQ ID NO: 769400 - protein, 1355 aa, Homo sapiens; identical to SEQ ID NO: 769390

SEQ ID NO: 769401 - protein, 1355 aa, Homo sapiens; identical to SEQ ID NO: 769390

SEQ ID NO: 769402 - protein, 163 aa, Homo sapiens
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQ

SEQ ID NO: 769403 - protein, 206 aa, Homo sapiens
LPVPVAASHARYQAQIMAGSRLETVGSIFSRTRDLVRAGVLKEKPLWFDVYDAFPPLREPVFQRPRVRYGKAKAPIQDIWYHEDRIRAKFYSVYGSGQRAFDLFNPNFKSTCQRFVEKYTELQKLGETDEEKLFVETGKALLAEGVILRRVGEARTQHGGSHVSRKSEHLSVRPQTALEENETQKEVPQDQHLEAPADQSKGLLPP

SEQ ID NO: 769404 - protein, 206 aa, Homo sapiens; identical to SEQ ID NO: 769403

SEQ ID NO: 769405 - protein, 206 aa, Homo sapiens; identical to SEQ ID NO: 769403

SEQ ID NO: 769406 - protein, 191 aa, Homo sapiens
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 769407 - protein, 162 aa, Homo sapiens
LRYLYTKRRNEGGPPQQGGFPCRSNCHGKGKRNWPRMSEPRATWSAQPLAIGEYSRCLSAPSELPSTRPGDETEGGSSPSMSARSSKPQETSHNTYVCTPKTNGEREGREARKAWCFLWVHPKQRLLLDTVIDEAWPLDVFTNYTLQVNSLPRPVRKSLGEL

SEQ ID NO: 769408 - protein, 191 aa, Homo sapiens; identical to SEQ ID NO: 769406

SEQ ID NO: 769409 - protein, 191 aa, Homo sapiens; identical to SEQ ID NO: 769406

SEQ ID NO: 769410 - protein, 191 aa, Homo sapiens; identical to SEQ ID NO: 769406

SEQ ID NO: 769411 - protein, 191 aa, Homo sapiens; identical to SEQ ID NO: 769406

SEQ ID NO: 769412 - protein, 86 aa, Homo sapiens
MSAGLEPVHQEVDAEVDQEQNIPESWQKLASGAAGMRVWALSVAEEQPPGRTKGCFVPSMLLLARVVFCLRPCTTCLFFLIFYLKE

SEQ ID NO: 769413 - protein, 714 aa, Homo sapiens
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSIGVNMYAMLTGTLPFTVEPFSLRALYQKMVDKEMNPLPTQLSTGAISFLRSLLEPDPVKRPNIQQALANRWLNENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 769414 - protein, 671 aa, Homo sapiens
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSMCHQFPALSPGTGSCEEAKYSAGTGESLAYENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 769415 - protein, 714 aa, Homo sapiens; identical to SEQ ID NO: 769413

SEQ ID NO: 769416 - protein, 714 aa, Homo sapiens; identical to SEQ ID NO: 769413

SEQ ID NO: 769417 - protein, 694 aa, Homo sapiens
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNYGKDIVKACSLLDVAVHMPCLGHTFNAGIQQAFQLPKLGALLSRCRKLVEYFQQSAVAMYMLYEKQKQQNVAHCMLVSNRVSWWGSTLAMLQRLKEQQFVIAGVLVEDSNNHHLMLEASEWATIEGLVELLQPFKQVAEMLSASRYPTISMVKPLLHMLLNTTLNIKETDSKELSMAKEVIAKELSKTYQETPEIDMFLNVATFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 769418 - protein, 115 aa, Homo sapiens
GAESRGRRGSGGGAAGAAMSPLSAARAALRVYAVGAAVILAQLLRRCRGGFLEPVFPPRPDRVAIVTGGTDGIGYSTAKHLARLGMHVIIAGNNDSKAKQVVSKIKEETLNDKET

SEQ ID NO: 769419 - protein, 694 aa, Homo sapiens; identical to SEQ ID NO: 769417

SEQ ID NO: 769420 - protein, 265 aa, Homo sapiens
RYKKVARKVATLRNMSISGVSWEVLESSLAMTSLAMLSSLESVSFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 769421 - protein, 216 aa, Homo sapiens
PHTHPQHSTHIHRSHEPRVFNPDEGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 769422 - protein, 317 aa, Homo sapiens
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDLYKHVFWATRLAKKLLGWLLFKTPDEGAWTSIYAAVTPELEGVGGRYLYNEKETKSLHVTYNQKLQQQLWF

SEQ ID NO: 769423 - protein, 294 aa, Homo sapiens
MSPLSAARAALRVYAVGAAVILAQLLRRCRGGFLEPVFPPRPDRVAIVTGGTDGIGYSTAKHLARLGMHVIIVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDLYKHVFWATRLAKKLLGWLLFKTPDEGAWTSIYAAVTPELEGVGGRYLYNEKETKSLHVTYNQKLQQQLWV

SEQ ID NO: 769424 - protein, 694 aa, Homo sapiens; identical to SEQ ID NO: 769417

SEQ ID NO: 769425 - protein, 150 aa, Homo sapiens
PGPTLPSPRVWPPRLSRVGLQPSSPRAAAPPRTLTPPGHGRGPGGSHAPRPRHQAALPAACGRPVTARPRQAPEGRSGRPRDLDPYPPQVFPPRPDRVAIVTGGTDGIGYSTAKHLARLGMHVIIAGNNDSKAKQVVSKIKEETLNDKET

SEQ ID NO: 769426 - protein, 694 aa, Homo sapiens; identical to SEQ ID NO: 769417

SEQ ID NO: 769427 - protein, 75 aa, Homo sapiens
IPGPSMWDVQRVLCLREDKLGWGGRCLGGMTPLSSRQCSAETPRTRGVRGQRNYLPFTAADFSGLQAAQNVILTS

SEQ ID NO: 769428 - protein, 370 aa, Homo sapiens
PGPTLPSPRVWPPRLSRVGLQPSSPRAAAPPRTLTPPGHGRGPGGSHAPRPRHQAALPAACGRPVTARPRQAPEGRSGRPRDLDPYPPQVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDLYKHVFWATRLAKKLLGWLLFKTPDEGAWTSIYAAVTPELEGVGGRYLYNEKETKSLHVTYNQKLQQQLWV

SEQ ID NO: 769429 - protein, 128 aa, Homo sapiens
LKGVPALLSPELLYALARMGHGDEIGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 769430 - protein, 135 aa, Homo sapiens
SPRVWAAPEVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 769431 - protein, 151 aa, Homo sapiens
LKGVPALLSPELLYALARMGHGDEIVLADLNFPASSICQCGPMEIRADGLGIPQLLEAVLKLLPLDTYVESPAAVMELVPSDKERGLQTPVWTEYESILRRAGCVRALAKIERFEFYERAKKAFAVVATGETALYGNLILRKGVLALNPLL

SEQ ID NO: 769432 - protein, 163 aa, Homo sapiens
RSCPHPHRGASGAAPTLFSASAWLRLDVPQSGETREEFRGGRAPICLSIKWVKVDRVCSVPQMLKQGLGTLALQPSSVLGLAPLQGDGPLRKPHPQEGGACPQPPAVGLVKTTWAGRGTGGTLSSSTTTHNRPPSGSSQTWALARALGAGSLGVGPANWDEYP

SEQ ID NO: 769433 - protein, 657 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 769434 - protein, 657 aa, Homo sapiens; identical to SEQ ID NO: 769433

SEQ ID NO: 769435 - protein, 255 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKGISK

SEQ ID NO: 769436 - protein, 657 aa, Homo sapiens; identical to SEQ ID NO: 769433

SEQ ID NO: 769437 - protein, 255 aa, Homo sapiens; identical to SEQ ID NO: 769435

SEQ ID NO: 769438 - protein, 345 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDSNFYDQNHEHTPAELQARTGITRR

SEQ ID NO: 769439 - protein, 325 aa, Homo sapiens
IEWPCEEVSRPETGERDGFARGAWDWSLLWKRIPLSHKEKAKRKHKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 769440 - protein, 255 aa, Homo sapiens; identical to SEQ ID NO: 769435

SEQ ID NO: 769441 - protein, 111 aa, Homo sapiens
MLTRNLASSTGCWGEKCWHLSLLALRRWLRALKRRMIPSWSRLTRGSSAPAVLSASPRPPALTPARLTAPLAAASHRELLPSASSRRRTPHPSRAQLSGHAHDAEILDFSG

SEQ ID NO: 769442 - protein, 136 aa, Homo sapiens
LICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEK

SEQ ID NO: 769443 - protein, 745 aa, Homo sapiens
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 769444 - protein, 219 aa, Homo sapiens
GCQWGLVSDILVSRLLVRGSPINKPGHRGPEIILEPEKKIPNSTLHFCEELVPNSGSLFGKNICCGKQCCICDLKSLLELDRDGEFQPERPKNSCPALLNAISRRTSIFPPPTSLLLPVTLASSQCCWATSGSAGGRGIAPTPGGQPCGSSRKSGSSCAWRWSPSGGSPWPCSRAGGAWRRLGTSLDTHPAGSRACRAVHQLAGESPTPRQARRPPFPT

SEQ ID NO: 769445 - protein, 402 aa, Homo sapiens
GCQWGLVSDILVSRLLVRGSPINKPGHRGPEIILEPEKKIPNSTLHFCEELVPNSGSLFGKNICCGKQCCICDLKSLLELDRDGEFQPERPKNSCPALLNAISRRTSIFPPPTSLLLPVTLASSQCCWATSGSAGGRGIAPTPGGQPCGSSRKSGSSCAWRWSPSGGSPWPCSRAGGAWRRLGTSLDTHPAGSRACRAVHQLQEKAQRLAKHEGLPSRLDEGRVAVEVAAHSDRAPAHVGTQGAVELQVCTSAQCTWIVHRHGAAIPLVVPVIITALAGLVATKELLRPRLQGIPTAWKSCAGCWKALCGGTSCGCSSSWKALRDGFKEAGSAPGRALKPLGGTMAMAQWVKARGSHGALGQSRVADHLHCRYKARVAEAMSPCESALDVLLTTQAQHFMFS

SEQ ID NO: 769446 - protein, 38 aa, Homo sapiens
MEMQDSWLSFQRGETRILSEWCPLQYPGSGARQDAPAG

SEQ ID NO: 769447 - protein, 1241 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMGILQNLAAMYGGRPSSSRGGKPRNKEEEVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDMFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 769448 - protein, 1257 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDMFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 769449 - protein, 1213 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDMFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 769450 - protein, 1213 aa, Homo sapiens; identical to SEQ ID NO: 769449

SEQ ID NO: 769451 - protein, 527 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRLDCDDP

SEQ ID NO: 769452 - protein, 382 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQII

SEQ ID NO: 769453 - protein, 113 aa, Homo sapiens
GHSRGGPVHLLALKKWVLSYGICDSQSPQSSRKGVSRWLFPRPSPPMDGFSVRVLSPFLPLYSIPRGTCELQGHLLNITFTQCPKEDSLFLEHCSILSPAVRIQFVLLRTSVA

SEQ ID NO: 769454 - protein, 216 aa, Homo sapiens
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEI

SEQ ID NO: 769455 - protein, 477 aa, Homo sapiens
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 769456 - protein, 348 aa, Homo sapiens
MSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQQPTLLAFGVKRSRDPRLPWT

SEQ ID NO: 769457 - protein, 477 aa, Homo sapiens; identical to SEQ ID NO: 769455

SEQ ID NO: 769458 - protein, 477 aa, Homo sapiens; identical to SEQ ID NO: 769455

SEQ ID NO: 769459 - protein, 633 aa, Homo sapiens
GCPLGEGQPQCVHSSPAKLVTSVTSAAPGPFVVSIGLCLSQAFEEQLSNSVTDNHLTVYTFKTTGKPQTRHRGMGKWRLRGCCRGNMQCRQEVPATLTSSELFSTRNQPQPQPQPLLADAPVPWAVASRLCVTPGQGCGHQGQDEGPLPAPSPPPAMSSSRKDHLGASSSEPLPVIIVGNGPSGICLSYLLSGYTPYTKPDAIHPHPLLQRKLTEAPGVSILDQDLDYLSEGLEGRSQSPVALLFDALLRPDTDFGGNMKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGADFAVDPDQPLSAKRNPIDVDPFTYQSTRQEGLYAMGPLAGDNFVRFVQGGALAVASSLLRKETRKPP

SEQ ID NO: 769460 - protein, 182 aa, Homo sapiens
GCPLGEGQPQCVHSSPAKLVTSVTSAAPGPFVVSIGLCLSQAFEEQLSNSVTDNHLTVYTFKTTGKPQTRHRGMGKWRLRGCCRGNMQCRQEVPATLTSSELFSTRNQPQPQPQPLLADAPVPWAVASRLCVTPGQGCGHQGQDEGEEGEASPQAQNFRGSKALPSPEYILCPCSVLTHQNS

SEQ ID NO: 769461 - protein, 272 aa, Homo sapiens
MSCHNCSDPQVLCSSGQLFLQPLWDHLRSWEALLQSPFFPVIFSITTYVGFCLPFVVLDILCSWVPALRRYKIHPDFSPSAQQLLPCLGQTLYQHVMFVFPVTLLHWARSPALLPHEAPELLLLLHHILFCLLLFDMEFFVWHLLHHKVPWLYRTFHKVHHQNSSSFALATQYMSVWELFSLGFFDMMNVTLLGCHPLTTLTFHVVNIWLSVEDHSGYNFPWSTHRLVPFGWYGGVVHHDLHHSHFNCNFAPYFTHWDKILGTLRTASVPAR

SEQ ID NO: 769462 - protein, 228 aa, Homo sapiens
MSCHNCSDPQVLCSSGQLFLQPLWDHLRSWEALLQSPFFPVIFSITTYVGFCLPFVVLDILCSWVPALRRYKIHPDFSPSAQQLLPCLGQTLYQHVMFVFPVTLLHWARSPALLPHEAPELLLLLHHILFCLLLFDMEFFVWHLLHHKVPWLYRTFHKVHHQNFGLLRHDERHTARVPPAHHPDLPRGQHLAFRGGPLRLQLPLVHSQTGALRVVRGCGAPRPASLSL

SEQ ID NO: 769463 - protein, 212 aa, Homo sapiens
KDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDA

SEQ ID NO: 769464 - protein, 74 aa, Homo sapiens
LTSHQAPTKPPGSSIFPIQSHYPNLYPRIPQTPPTSPLPQTRSPPNFSLPSSALTTHSPSYLALSRAGPAGSPH

SEQ ID NO: 769465 - protein, 118 aa, Homo sapiens
QLLGRLRQENHLNLRGGGSSELRSHRCTPAWATEQDSLSKQTKQNKKQSKKLKPLLACGRYKNRWPSGFDPWVLVCPLTPGLAKVVIPGGTDGAGGLRNFQGSISGERGFVLFERYQP

SEQ ID NO: 769466 - protein, 200 aa, Homo sapiens
LLAEWRLVYSNPDMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 769467 - protein, 112 aa, Homo sapiens
TRFHVEAQAAVSQEQFHGDSRGPGGCPGPRKCASWLGVKASRSARNGVGVEEVRMGEKQGGTEPAGADVLNSRLQARVANSARDSICCVFKSFITGMRVFCVRKNSRLWRRG

SEQ ID NO: 769468 - protein, 70 aa, Homo sapiens
HPGHGQPPGCPPAPPSPRRVRITRQHLDSSRVGEAPWFLRRKDAGWGRQILPGLGAFPFHQEPARETRKH

SEQ ID NO: 769469 - protein, 123 aa, Homo sapiens
AFWQFLGAANAPPRGSAAGNAGFGALGAAAFPCFPPSPRRHGQVGPGEPPLDRGGAGGRDQREQLALARLAAASFRDLGRAGPREPGLPWGLCGAAGPGGQGAAPPQLLDAGLGLRLSARESP

SEQ ID NO: 769470 - protein, 123 aa, Homo sapiens; identical to SEQ ID NO: 769469

SEQ ID NO: 769471 - protein, 149 aa, Homo sapiens
MKALCSATTPRSLALPGLLQPTQPAASLAAQQSLNERSPDTGPGVHGGPSRHLLPCLGRVCAAEEPRLQSTPTGPFHPLARPSRTYTDPCILVSAAPGGVGSLGPDSGSSLPQTRVDVQTAQKDLLALAEAQSERRVELHAQEAVGVAV

SEQ ID NO: 769472 - protein, 72 aa, Homo sapiens
QDALRAKSRGVLSGGPAVLPQGRGFSFTTAKTHRTLLHPRAKDTRKEGQSEEVSECFRSHSDILLDGFRNPS

SEQ ID NO: 769473 - protein, 127 aa, Homo sapiens
MLILKGLERPVEEGQSVEMPGNSLIFLEAKGSKILLWKLSYYISAFKKWLQDYEVLQCCPPSPVYIAVKTPRHGGHHWHCSSQQLFGCEVPHSCKTQPEGACLHDPPAQSPHLSVTAVKSAPVVFRN

SEQ ID NO: 769474 - protein, 505 aa, Homo sapiens
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 769475 - protein, 505 aa, Homo sapiens; identical to SEQ ID NO: 769474

SEQ ID NO: 769476 - protein, 505 aa, Homo sapiens; identical to SEQ ID NO: 769474

SEQ ID NO: 769477 - protein, 343 aa, Homo sapiens
NRPAPALSPQVSCRHSISGGPGRWQEFLMAEESLPGTLLKLAAQGLGMQAACTLTRLCWAWELSDLHLLQSLMAQSCSSALRTSVPHGALVEAACAFCFHLTLLHLRHSPPAYKRARCGSVGHRHGLHGRALHVCLLQPCPGRLCDLCLLGTHLTGVRAGVLAGPSDRMVLAVLLHQWAAFPNFSRGTLFYRPEEQVPSTPREAGPASGDTQTLQKGVSVREPGRSGVEGATFQLSGLALCEPRAEAPGLVAGTLGNLLVAKERNSLGPHVPPRKRPVGANVKPKYRNEERTAAQQQQQHTWRGPALKTYTRDEGGARNSIAGHAQALVCPTLAVHTHDTGQR

SEQ ID NO: 769478 - protein, 442 aa, Homo sapiens
NRPAPALSPQVSCRHSISGGPGRWQEFLMAEESLPGTLLKLAAQGLGMQAACTLTRLCWAWELSDLHLLQSLMAQSCSSALRTSVPHGALVEAACAFCFHLTLLHLRHSPPAYKRARCGSVGHRHGLHGRALHVCLLQPCPGRLCDLCLLGTHLTGVRAGVLAGPSDSLSGMCRVLGSIRSASGTPSCPPLPRQHCPLLGTAPCWPLCPTHWALQGFSETLQVQGAASGNRKTGLCPSISPFIHKFRYHAGALEELQGLQPGAPEPGMVLAVLLHQWAAFPNFSRGTLFYGQKNKYRAPRGNAGPASGDTQTLQKGVSVREPGRSGVEGATFQLSGLALCEPRAEGPWLVAGTLGNLLVAKERNSLGPHVPPRKRPVGANVKPKYRNEERTAAQQQQQTHMAGARPKTYTRDEGGARNSIAGHAQALVCPTLAVHTHDTGQR

SEQ ID NO: 769479 - protein, 263 aa, Homo sapiens
NRPAPALSPQVSCRHSISGGPGRWQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTEEQHGEVMEPPLGPRSGDSGPWLQRPRWSPHLLLHLLSDTRLHLTEVPEGQLGSYGILEAFFSFCWLYTVDGLRGNASASPWGAPTGAVGLSGPGP

SEQ ID NO: 769480 - protein, 318 aa, Homo sapiens
AARRASKALLPVGAYEVFAREAVGAVQLGACFLEMRTLVELGPWAGDFGPDLLLTLLFLLFLAHGVTLDGASANPTVSLQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTEEQHGEVMEPPLGPRSGDSGPWLQRPRWSPHLLLHLLSDTRLHLTEVPEGQLGSYGILEAFFSFCWLYTVDGLRGNASASPWGAPTGAVGLSGPGP

SEQ ID NO: 769481 - protein, 181 aa, Homo sapiens
MELAKNFSDETGKGGNPEGFTLHLAQVERIQGQLLAILNSRLRLKGSFTRAAKERRSCQDRLHRCRSPALRAYTRAHTRVHTRAHTCMHTHACTHMYAHTCMHTRTHMHTCMHTCTHARTRVHAHACTQTRTRTHMHAHTHTHAHTRTHACTHTHACTHVHLGYLLLMSALCPKLDLKTCR

SEQ ID NO: 769482 - protein, 141 aa, Homo sapiens
MELAKNFSDETGKGGNPEGFTLHLAQVERIQGQLLAILNSRLRLKGSFTRAAKERRSCQDRLHRCRSPALRAYTRAHTRVHTRAHTCMHTHACTHMYAHTCMHTHAHAHTCMHTRTHMHTHAHTHAHTHMHAHTCILDISC

SEQ ID NO: 769483 - protein, 384 aa, Homo sapiens
MLSRQKTKNEVSKPAEVQGKYVKKETSPLLRNLMPSFIQHGPKIPGRTDICLPDSSPNAFSTSGDGVVSRNQSFLRTPIQRTPHKIMRRESNRLSAPSYLARSLADVPREYGSSQSFVTEVSFAVENGDSGSRYYYSDNFVDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 769484 - protein, 283 aa, Homo sapiens
RARGFGGGGRGRGRGGGDGKDRGGGGQRRGGVAKSKSRRRKGAMVVSVEPARHEGVFIYRGAEDALVTLNMVPGQSVYGERRITVTEGGVIARRYRTWNPFRSKLAAAILGGVDQIHIKPKSKVLYLGAASGTTVSHVSDIIGPDGLVYAVEFSHRAGRDLVNVAKKRTNIIPVLEDARHPLKYRMLIGMVDVIFADVAQPDQSRIVALNAHTFLRNGGHFLISIKANCIDSTASAEAVFASEVRKLQQENLKPQEQLTLEPYERDHAVVVGVYRPLPKSSSK

SEQ ID NO: 769485 - protein, 147 aa, Homo sapiens
AAMKGRRLGGVALRSAADGAFVSGEFCGGKLLRWCLVTDFPPDSCTTCSYSRRSTPGCSPGGSRGLSEGEGSSVSLQRSRVLSAMKHVLNLYLLGVVLTLLSIFVRVMESLEGLLESPSPGTSWTTRSQLANTEPTKGLPDHPSRSM

SEQ ID NO: 769486 - protein, 313 aa, Homo sapiens
MPVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 769487 - protein, 380 aa, Homo sapiens
GVMAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 769488 - protein, 104 aa, Homo sapiens
MPVILALWEAEVGGSPEVRSSRPASPTWRNPISTKNTKVSWVWWQRPVIPAPWEAEAGELLEPGDGGCSEPRSHCCTQPGPQCKTPSQHNQKKPGTLSRAGDKG

SEQ ID NO: 769489 - protein, 239 aa, Homo sapiens
MPGNHPAPSPGLSLAVCPAASEHSEKPLTAGTSQAALPEALSKGRETPRPATHPARSQDVKPLSCPFDFLRDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVTFYCLGSGICEAIIFVHM

SEQ ID NO: 769490 - protein, 132 aa, Homo sapiens
MKSMDPASGYSNNILTIDQMLKKKQTCIVADATTIKQHVKRATDTYNLGIALEHRKEMLNLWQKIRGDLIGIDSRNEAFYDTFSTYTWSWNVCQELLSPKDLRLYDAYVNRNSSHNCRSSSSSDTSECDTDS

SEQ ID NO: 769491 - protein, 147 aa, Homo sapiens; identical to SEQ ID NO: 769485

SEQ ID NO: 769492 - protein, 147 aa, Homo sapiens; identical to SEQ ID NO: 769485

SEQ ID NO: 769493 - protein, 147 aa, Homo sapiens; identical to SEQ ID NO: 769485

SEQ ID NO: 769494 - protein, 153 aa, Homo sapiens
YAEQPLTRLAITYGSVRGVFTTSVATQCCEQFCGGKLLRWCLVTDFPPDSCTTCSYSRRSTPGCSPGGSRGLSEGEGSSVSLQRSRVLSAMKHVLNLYLLGVVLTLLSIFVRVMESLEGLLESPSPGTSWTTRSQLANTEPTKGLPDHPSRSM

SEQ ID NO: 769495 - protein, 110 aa, Homo sapiens
AAIRGGGWAALLCALRLTALLSPVRSRGLSEGEGSSVSLQRSRVLSAMKHVLNLYLLGVVLTLLSIFVRVMESLEGLLESPSPGTSWTTRSQLANTEPTKGLPDHPSRSM

SEQ ID NO: 769496 - protein, 85 aa, Homo sapiens
VNRLSSTRRSGDPTPGVPGSDGVPRGLTREPIAWDLLDHQKPTSQHRAHQGPSRPSIQKHVIRPPSILAIFWNTDLDMSRWESHS

SEQ ID NO: 769497 - protein, 171 aa, Homo sapiens
YAEQPLTRLAITYGSVRGVFTTSVATQCCEQFCGGKLLRWCLVTDFPPDSCTTCSYSRRSTPGCSPGGERPCGLPRLPTPIARVLAALAASRSRAGGAPPGSSLIAHAPSGVPIQPSALFCPKVVLTRIHVAHPTPTGAELGIPAMPSQSTFTISLLSQHLACCVLTTLCL

SEQ ID NO: 769498 - protein, 372 aa, Homo sapiens
AAMKGRRLGGVALRSAADGAFVSGEFCGGKLLRWCLVTDFPPDSCTTCSYSRRSTPGCSPGVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 769499 - protein, 239 aa, Homo sapiens
GVMAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQVSTMGNYLLVISTD

SEQ ID NO: 769500 - protein, 171 aa, Homo sapiens; identical to SEQ ID NO: 769497

SEQ ID NO: 769501 - protein, 171 aa, Homo sapiens; identical to SEQ ID NO: 769497

SEQ ID NO: 769502 - protein, 285 aa, Homo sapiens
GVMAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQFTLSHCTDVISVHILKVCGNPASSKPTSAVSPPPYAHLVSVCHALVILRIFQTFLLLCML

SEQ ID NO: 769503 - protein, 207 aa, Homo sapiens
GVMAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNKNF

SEQ ID NO: 769504 - protein, 115 aa, Homo sapiens
YAEQPLTRLAITYGSVRGVFTTSVATQCCEQFCGGKLLRWCLVTDFPPDSCTTCSYSRRSTPGCSPGGSRGLSEGEGSSVSLQRSRVLSAMKHVLNLYLLGSKYEVYGPCLRLFK

SEQ ID NO: 769505 - protein, 132 aa, Homo sapiens
YAEQPLTRLAITYGSVRGVFTTSVATQCCEQFCGGKLLRWCLVTDFPPDSCTTCSYSRRSTPGCSPGVDYEINAHKYWNDFYKIHENGFFKDRHWLFTEFPELAPSQNQNHLKDWFLENKSEPVSTQNTKKN

SEQ ID NO: 769506 - protein, 91 aa, Homo sapiens
GTRGRGAHAQSGKPKAWRGFREQGLEFLCQAGGWHQTPGRGRRRGPSKDSPQPLCLRLLRLLCADRVLCCVGNAASPPHPLAAFNPTFLIV

SEQ ID NO: 769507 - protein, 92 aa, Homo sapiens
GTRGRGAHAQSGKPKAWRGFREQGLEFLCQAGGWHQTPGRGRRRGPSKDSPQPLCLRLLRLLCADRVLCCVGNAASLLGTWIPFPSSSPGYF

SEQ ID NO: 769508 - protein, 49 aa, Homo sapiens
MQNGAVNLASSAASEKLNLHLPYDPAISFLSIYGRQTKIYGQHKNLYLH

SEQ ID NO: 769509 - protein, 125 aa, Homo sapiens
MGPGGPLLSPSRGFLLCKTGWHSNRLLGDCGPHTPVSTALSFIAVGMAAPSMKERQVCWGARDEYWKCLDENLEDASQCKKLRSSFESSCPQQWIKYFDKRRDYLKFKEKFEAGQFEPSETTAKS

SEQ ID NO: 769510 - protein, 114 aa, Homo sapiens
KRPPKRGFWPLKPKNWGTRGPPHTCFLQGFFIAVGMAAPSMKERQVCWGARDEYWKCLDENLEDASQCKKLRSSFESSCPQQWIKYFDKRRDYLKFKEKFEAGQFEPSETTAKS

SEQ ID NO: 769511 - protein, 169 aa, Homo sapiens
FFLEPCAPLLAEPLLERDEAEGVGGADAGPALLYGLVGDGELAQVVANHLGLDLHLVEGLAVVDAHHAAHHLGQDDHVPQVRLHHFRLLHGRRLLLGLAQALQQVVPLPPQAPVQPPPLARTVQLHQLFVGHVQQLVQVHAAVGELAEGPLLLLLYFCHLAGSSERAIC

SEQ ID NO: 769512 - protein, 164 aa, Homo sapiens
FFLEPCAPLLAEPLLERDEAEGVGGADAGPALLYGLVGDGELAQVVANHLGLDLHLVEGLAVVDAHHAAHHLGQDDHVPQVRLHHFRLLHGRRLLLGLAQALQQVVPLPPQAPVQPPPLARTVQLHQLFVGHVQQLVQVHAALHRSRNGSPIYEGKTGLLGGPG

SEQ ID NO: 769513 - protein, 155 aa, Homo sapiens [sequence omitted]

SEQ ID NO: 769514 - protein, 137 aa, Homo sapiens
MVARKGQKSPRFRRVTCFLRLGRSTLLELEPAGRPCSGRTRHRALHRRLVACVTVSSRRHRKEAGRGRAESFIAVGMAAPSMKERQVCWGARDEYWKCLDENLEDASQCKKLRSSFESSCPQQWTVSLCCPGWSAVV

SEQ ID NO: 769515 - protein, 125 aa, Homo sapiens; identical to SEQ ID NO: 769509

SEQ ID NO: 769516 - protein, 155 aa, Homo sapiens [sequence omitted]

SEQ ID NO: 769517 - protein, 155 aa, Homo sapiens [sequence omitted]

SEQ ID NO: 769518 - protein, 518 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769519 - protein, 518 aa, Homo sapiens; identical to SEQ ID NO: 769518

SEQ ID NO: 769520 - protein, 490 aa, Homo sapiens
MGEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769521 - protein, 496 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769522 - protein, 502 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGKSGHWSWLFQKCFFTHGRQNKTLHIIIHLLKKSLLSLEQ

SEQ ID NO: 769523 - protein, 480 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEVVKGLQEVGLPLHRGCLLIAEMSSTGSLATGDYTRAAVRMAEEHSEFVVGFISGSRVSMKPEFLHLTPGVQLEAGGKSGHWSWLFQKCFFTHGRQNKTLHIIIHLLKKSLLSLEQ

SEQ ID NO: 769524 - protein, 443 aa, Homo sapiens
TFPTDGGSKQAARDNGGRSCSFGAIGDGSVRRAGFQVWGLRAEERAFLPHLHRSAGHRVSTASSESGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769525 - protein, 386 aa, Homo sapiens
GVQDQPRQHRTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769526 - protein, 110 aa, Homo sapiens [sequence omitted]

SEQ ID NO: 769527 - protein, 139 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTRLSRFKKEDQEGA

SEQ ID NO: 769528 - protein, 481 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLAHTIAHRSYWRGRHM

SEQ ID NO: 769529 - protein, 527 aa, Homo sapiens
TFPTDGGSKQAARDNGGRSCSFGAIGDGSVRRAGFQVWGLRAEERAFLPHLHRSAGHRVSTASSESDGISLTSPRLECSSVIIAHCSLELLGLRDLLAWVADILFQTAQNAGISFDTVCGVPYTALPLATVICSTNQIPMLIRRKETKDYGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769530 - protein, 384 aa, Homo sapiens
RTRGSTHGTKRLVEGTINPGETCLIIEDVVTSGSSVLETVEVLQKEGLKVTDAIVLLDREQGGKDKLQAHGIRLHSVCTLSKMLEILEQQKKVDAETVGRVKRFIQENVFVAANHNGSPLSIKEAPKELSFGARAELPRIHPVASKLLRLMQKKETNLCLSADVSLARELLQLADALGPSICMLKTHVDILNDFTLDVMKELITLAKCHEFLIFEDRKFADIGNTVKKQYEGGIFKIASWADLVNAHVVPGSGVVKGLQEVGLPLHRGCLLIAEMSSTGSLATGDYTRAAVRMAEEHSEFVVGFISGSRVSMKPEFLHLTPGVQLEAGGDNLGQQYNSPQEVIGKRGSDIIIVGRGIISAADRLEAAEMYRKAAWEAYLSRLGV

SEQ ID NO: 769531 - protein, 147 aa, Homo sapiens
GKLQTRQAEEAGLRGRDVIGAPEARGAWEFEANRQRATMAVARAALGPLVTGLYDVQAFKFGDFVLKSGLSSPIYIDLRGIVSRPRLLSQVADILFQTAQNAGISFDTVCGVPYTALPLATVICSTNQIPMLIRRKETKDYGKIKVT

SEQ ID NO: 769532 - protein, 201 aa, Homo sapiens
MGGCFSKPKPVELKIEVVLPEKERGKEELSASGKGSPRAYQGNGTARHFHTEERLSTPHPYPSPQDCVEAAVCHVKDLENGQRSVPWSGALPLARRLLQHQHWGPGGLPWPGQSTQVPGGDGSDPPPSWHPQALQLQRRTKVMAKCISPSAGYSSSTNVLIVGAGAAGLVCAETLRQEGFSDRIVLCTLDRHLPYDRPKLS

SEQ ID NO: 769533 - protein, 241 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVGVKIEKEKVYVRASKQALQLQRRTKVMAKCISPSAGYSSSTNVLIVGAGAAGLVCAETLRQEGFSDRIVLCTLDRHLPYDRPKLS

SEQ ID NO: 769534 - protein, 116 aa, Homo sapiens
MVWPASPPAASVAAPTRMTHRSAQQCPHPNTLHNQVWCLHSSQAGACPPVPHAHAHTGAPTSPHPILLSTYLRRKLEGCGPVRVSCFPLHPAAVESHGPPPAPITKQHNNRLSEFR

SEQ ID NO: 769535 - protein, 170 aa, Homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 769536 - protein, 170 aa, Homo sapiens; identical to SEQ ID NO: 769535

SEQ ID NO: 769537 - protein, 164 aa, Homo sapiens
CIPRSVRIPHFTRVLPALLLAPWPAGLFLAMGRSRRTGAHRAHSLARQMKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 769538 - protein, 134 aa, Homo sapiens
MGRSRRTGAHRAHSLARQMKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 769539 - protein, 134 aa, Homo sapiens; identical to SEQ ID NO: 769538

SEQ ID NO: 769540 - protein, 134 aa, Homo sapiens; identical to SEQ ID NO: 769538

SEQ ID NO: 769541 - protein, 74 aa, Homo sapiens
MDTYKELIERIPELNKVARAAAEVAGQFVIKLTHDVELNLDYERYNSQLLSFVRDLNQYRADIKVSTDSNYVFI

SEQ ID NO: 769542 - protein, 52 aa, Homo sapiens
AVGRRGEEDPCNLLVAQVSLLSVDEMYQNLPPAEKDQYWDEDQPQPPYTVAT

SEQ ID NO: 769543 - protein, 118 aa, Homo sapiens
PFFRSEHWATGVVWEGPLTSLPLKVSSHKIWCAQANAGTYYGKSFSFRSLLFLSSTSDMTNAQQWRQEDSPPSVRAYSPAHVSLSLRCIANSCQAFWNDFLTRKAPYFNGPIQTTDIC

SEQ ID NO: 769544 - protein, 146 aa, Homo sapiens
RIALARTSSTMLKRSGESRLFVLFQFQRECFHLFPIQYYVGCGSVIDGFYYIKTQLRTPGLRTTSHCHVNPFPGQCVLGLEPNLLDSLGPSIFGVVGNLVAIVVLCKSRKEQKETTFYTVMRLVATDLLFTLLVSQVTIAMYMKGG

SEQ ID NO: 769545 - protein, 68 aa, Homo sapiens
LGERQTPGVRLPPAETRQGPREGDVGGEGYGWRSRRAWAGSGATRTHSGFPSFSVRWLSYPSLHNQRV

SEQ ID NO: 769546 - protein, 104 aa, Homo sapiens
KPPTPAVHFSVRTEVTLGDSKFDFLPTLAANGSSRSSSGTKTWQHQNAQSHVRLLEWTPKPPGTQRASCLPAPATPAPAKGNPAPGYGCLHKHTRCLYWHLAPL

SEQ ID NO: 769547 - protein, 115 aa, Homo sapiens
GISTDRNFHRARTVLFMGSCLPQMASITVGNVFIVKKFCYLHAPSSYKITCLIVNVPHLHPTFSIPTPQSLPYHHLADSCTFHSCQLCNLPFPVQGTFLIMAHCLRSVPLLRLSH

SEQ ID NO: 769548 - protein, 416 aa, Homo sapiens
MLEGQLEAGEPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSPQNSGGRKSPVQASQATTLQEQTAAARGADRSSSVLGSSEGGFLSRVQADEFASSSPDSAERQEKFYPNGSKEIVFPDGTVEHLKDGQEETLFPDGTIVRVERNGDKTIVLSNGQKEIHTARFKRREYPDGTVKTVYCSGCQETKYASGRVKIKDEAGNVVLDEKQMSPQHAASHGKCQLQIFAKTDKN

SEQ ID NO: 769549 - protein, 235 aa, Homo sapiens
PFKTESPLEPSAALWSLEMRREDLGTAVGTRPRCSGPSRSDWRGPGEVMRSVSGAEGRGLPQTEGVTSLGPRTLGYPLGGAGKKKLSQGCEDRGPLPTSTETVPIPAGKEQPGIRLLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKVTSETWVTLHWQHGKFRFR

SEQ ID NO: 769550 - protein, 238 aa, Homo sapiens
MLEGQLEAGEPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKVTSETWVTLHWQHGKFRFR

SEQ ID NO: 769551 - protein, 174 aa, Homo sapiens
MLEGQLEAGEPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKVTLRAYRL

SEQ ID NO: 769552 - protein, 134 aa, Homo sapiens
MLEGQLEAGEPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLVPKAHLCFCIICVV

SEQ ID NO: 769553 - protein, 72 aa, Homo sapiens
MTSPLEKDPEPNGALSPGPGDTNSWGFGRDPAPSPRDSLAPEDLEMFVLDFEDGDLWESIRGQLGPMAGPPT

SEQ ID NO: 769554 - protein, 134 aa, Homo sapiens; identical to SEQ ID NO: 769538

SEQ ID NO: 769555 - protein, 118 aa, Homo sapiens
MGRSRRTGAHRAHSLARQMKAKRRRPDLDEIHRELRPQGSARPQPDPNAEFDPDLPGGGLHRCLACARYFIDSTNLKTHFRSKDHKKRAAGMGSYVPPRRLAVPTEVSTEVPEMDTST

SEQ ID NO: 769556 - protein, 134 aa, Homo sapiens; identical to SEQ ID NO: 769538

SEQ ID NO: 769557 - protein, 400 aa, Homo sapiens
INLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 769558 - protein, 458 aa, Homo sapiens
QSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 769559 - protein, 109 aa, Homo sapiens
QSTATGDGVARAFLRAQAALFGSYRDALRYKPGEPITFCEESFVKHRSSVMKQFLETAINLQLFKQFIDGRLAKLNAGRGFSDVFEEEITSGGFCGGKDKLQYDYPFSQ

SEQ ID NO: 769560 - protein, 139 aa, Homo sapiens
QSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFVSFFDI

SEQ ID NO: 769561 - protein, 243 aa, Homo sapiens
LPPASRSHFLLEPGAAAAAPSSPASGRAPGHCSQRGPEERGGTASTTATAPTMQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 769562 - protein, 243 aa, Homo sapiens; identical to SEQ ID NO: 769561

SEQ ID NO: 769563 - protein, 243 aa, Homo sapiens; identical to SEQ ID NO: 769561

SEQ ID NO: 769564 - protein, 191 aa, Homo sapiens
MQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 769565 - protein, 68 aa, Homo sapiens
RERERERERERERFAEAVAGLSIRGSAHVDLGQCLALQQDGVKEVFAEAVRAVLNPTPIKRGRSCILL

SEQ ID NO: 769566 - protein, 243 aa, Homo sapiens; identical to SEQ ID NO: 769561

SEQ ID NO: 769567 - protein, 68 aa, Homo sapiens; identical to SEQ ID NO: 769565

SEQ ID NO: 769568 - protein, 103 aa, Homo sapiens
ASQRRRLCVGQTSGPRPGIQGQPLTRFLIPDGWRRLTPKVKGLLGKETIVKSSWAKLALQTGGARSWPNSGSGTIPEHPIPGIMFWKPPRRAQFSGVALVSSH

SEQ ID NO: 769569 - protein, 407 aa, Homo sapiens
EPFFSGLGIPASARGYAAGVWAATVGKVTSAAAPKRVSRAGAMEGQSVEELLAKAEQDEAEKLQRITVHKELELQFDLGNLLASDRNPPTGLRCAGPTPEAELQALARDNTQLLINQLWQLPTERVEEAIVARLPEPTTRLPREKPLPRPRPLTRWQQFARLKGIRPKKKTNLVWDEVSGQWRRRWGYQRARDDTKEWLIEVPGNADPLEDQFAKRIQAKKERVAKNELNRLRNLARAHKMQLPSAAGLHPTGHQSKEELGRAMQVAKVSTASVGRFQERLPKEKVPRGSGKKRKFQPLFGDFAAEKKNQLELLRVMNSKKPQLDVTRATNKQMREEDQEEAAKRRKMSQKGKRKGGRQGPGGKRKGGPPSQGGKRKGGLGGKMNSGPPGLGGKRKGGQRPGGKRRK

SEQ ID NO: 769570 - protein, 407 aa, Homo sapiens; identical to SEQ ID NO: 769569

SEQ ID NO: 769571 - protein, 48 aa, Homo sapiens
LASQVRTRGIRETQLSSFTPANTHELIQYLLTTHYILDLTGLMKGEEE

SEQ ID NO: 769572 - protein, 266 aa, Homo sapiens
TISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPDGGGYSSFGLVQPRPPLEPSPTGRHRGVRAVSRAGLRRHRPCHGCHAVQSGNSRGCAKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLF

SEQ ID NO: 769573 - protein, 115 aa, Homo sapiens [sequence omitted]

SEQ ID NO: 769574 - protein, 504 aa, Homo sapiens
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 769575 - protein, 359 aa, Homo sapiens
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVCRDHYPWDHIQISY

SEQ ID NO: 769576 - protein, 108 aa, Homo sapiens [sequence omitted]

SEQ ID NO: 769577 - protein, 102 aa, Homo sapiens
MEAAATPAAAGAARREELDMDVMRPLINEQNFDGTSDEEHEQELLPVQKHYQLDDQEGISVSVMVYKSPFLLIQYVFCNLLLQARHSITLQDTNIRHSLHLQ

SEQ ID NO: 769578 - protein, 504 aa, Homo sapiens; identical to SEQ ID NO: 769574

SEQ ID NO: 769579 - protein, 504 aa, Homo sapiens; identical to SEQ ID NO: 769574

SEQ ID NO: 769580 - protein, 564 aa, Homo sapiens
DKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 769581 - protein, 167 aa, Homo sapiens [sequence omitted]

SEQ ID NO: 769582 - protein, 177 aa, Homo sapiens
CHDIPQGAGARWPRVSPVVEPCSPRLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 769583 - protein, 208 aa, Homo sapiens
ARGPLAARGLRLLLPLLPLLPLLPLPQVALGFADGSCDPSDQCPPQARWSSLWHVGLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 769584 - protein, 131 aa, Homo sapiens
MAPSLWKGLVGIGLFALAHAAFSAAQHRSYMRLTEKEDESLPIDIVLQTLLAFAVTCYGIVHIAGEFKDMDATSELKNKTFDTLRNHPSFYVFNHRGRVLFRPSDTANSSNQDALSSNTSLKLRKLESLRR

SEQ ID NO: 769585 - protein, 109 aa, Homo sapiens
MAPSLWKGLVGIGLFALAHAAFSAAQHRSYMRLAEERHNRLEERKRQRKEERRITYYREKEEEEQRRAEEQMLKEREERERAERAKREEELREYQEGVKKLEEVGREKT

SEQ ID NO: 769586 - protein, 733 aa, Homo sapiens
SKQLPAGPGRGRRREGGAARAVGAPRAGPASVCPRRQPAPDAPPGRSKKRPKFAAAVSWSSRRAAAPGAPGASLASRYCLQTLLLSAAAPNSADAGRGEPSRGRCAQRSGQAGRAWAGARAGVESRGQQQPVPGSGGAEGRGAPREDTSNASMQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 769587 - protein, 439 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTGTFRCTFCHTEVEEDESAMPKKDARTLLARFNEQIEPIYALLRETEDVNLAYEILEPEPTEIPALKQSKDHAATTAGAASLAGGHHREAWATKGPSYEDLYTQNVVINMDDQEDLHRASLEGKSAKERPIWLRESTVQGAYGSEDMKEGGIDMDAFQEREEGHAGPDDNEEVMRALLIHEKKTSSAMAGSVGAAAPVTAANGSDSESETSESDDDSPPRPAAVAVHKREEDEEEDDEFEEVADDPIVMVAGRPFSYSEVSQRPELVAQMTPEEKEAYIAMGQRMFEDLFE

SEQ ID NO: 769588 - protein, 150 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTG

SEQ ID NO: 769589 - protein, 177 aa, Homo sapiens
SCRAKLFEDPPRYIKSGVRKLYHERNHDVLIEVAYHRCGEPGDVTPGIEWILNVLLTLDTVCTHRTSSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTG

SEQ ID NO: 769590 - protein, 439 aa, Homo sapiens; identical to SEQ ID NO: 769587

SEQ ID NO: 769591 - protein, 198 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTGTFRCTFCHTEVEEDESAMPKKDARTLLARFNEQIEPIYALLRVHPVYH

SEQ ID NO: 769592 - protein, 233 aa, Homo sapiens
MADPDVLTEVPAALKRLAKYVIRGFYGIEHALALDILIRNSCVKEEDMLELLKFDRKQLRSVLNNLKGDKFIKCRMRVETAADGKTTRHNYYFINYRTLVNVVKYKLDHMRRRIETDERDSTNRASFKCPVCSSTFTDLEANQLFDPMTGTFRCTFCHTEVEEDESAMPKKDARTLLARFNEQIEPIYALLRETEDVNLAYEILEPEPTEIPALKQSKDLWWPMLPGGAHLLG

SEQ ID NO: 769593 - protein, 66 aa, Homo sapiens
CAAYQAGQGHQGPGQDSGTVHAGRVEFMDDTSRSIIRNVKGPVREGDVLTLLESEREARRLRSACL

SEQ ID NO: 769594 - protein, 70 aa, Homo sapiens
TSVSAIAGQGTQRVPCGSDRSSGNQCARQGCRVEFMDDTSRSIIRNVKGPVREGDVLTLLESEREARRLR

SEQ ID NO: 769595 - protein, 194 aa, Homo sapiens
LIYIFINSVRGFSVFCTLASIRFFLSFDKNHFNWGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFT

SEQ ID NO: 769596 - protein, 136 aa, Homo sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLDSRPTWIRDRPGFATDLDSRPTWIRDRPGFAT

SEQ ID NO: 769597 - protein, 243 aa, Homo sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKK

SEQ ID NO: 769598 - protein, 112 aa, Homo sapiens
MDANDHEKTVQKYETTHLQGSKSPKTVYELASLFLFNPYLTRKRRIEVSHALGLTERQVKIWFQNRRMKWKKENNKDKFPSSKCEQEELEKQKLERAPEAADEGDAQKGDKK

SEQ ID NO: 769599 - protein, 279 aa, Homo sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKKNGSVQGPWAGSCALGAPRKTCSISARISGAPRETES

SEQ ID NO: 769600 - protein, 241 aa, Homo sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDNFPSQSSLPSATPQLAGFLSGFSLFLLHPPPLV

SEQ ID NO: 769601 - protein, 124 aa, Homo sapiens
AQDIPKSPNFNGSPDSQPLLTPERRSASFRYYAGREVEKFNRRSQAISARCKTVRRISPAETNKVKVSAEPNRPSPSRPYILRYVDRTREPSASGTGKKQVHLTLKLFNTPPRKKPTLKPQITK

SEQ ID NO: 769602 - protein, 114 aa, Homo sapiens
MVKAISTVQDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 769603 - protein, 152 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSGCFHSRMQIQGICV

SEQ ID NO: 769604 - protein, 114 aa, Homo sapiens; identical to SEQ ID NO: 769602

SEQ ID NO: 769605 - protein, 114 aa, Homo sapiens; identical to SEQ ID NO: 769602

SEQ ID NO: 769606 - protein, 114 aa, Homo sapiens; identical to SEQ ID NO: 769602

SEQ ID NO: 769607 - protein, 119 aa, Homo sapiens
RFSMKILELSLKKGVHMLQCLCGRSLRSSDTPSEPQLKGIVTRLFSQQGYFLQMHPDGTIDGTKDENSDYTLFNLIPVGLRVVAIQGVKASLYVAMNGEGYLYSSGCFHSRMQIQGICV

SEQ ID NO: 769608 - protein, 121 aa, Homo sapiens
PPPPPPPPRKSRLALTDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 769609 - protein, 488 aa, Homo sapiens
MAAGSEATTPVIVAAGAGGEEGEHVKPFKPEKAKEIIMSLQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRKRWHLFPPEDTPFLYPTRIPYEESSVFSKINVVNPDLKRFPQFRKAQRHAVTLSPGQVLFVPRHWWHYVESIDPVTVSINSWIELEEDHLARVEEAITRMLVCALKTAENPQNTRAWLNPTEVEETSHAVNCCYLNAAVSAFFDRCRTSEVVEIQALRTDGEHMKKEELNVCNHMEVGQTGSQNLTTGTDKPEAASPFGPDLVPVAQRSEEPPSERGGIFGSDGKDFVDKDGEHFGKLHCAKRQQIMSNSENAIEEQIASNTTTTPQTFISTDDLLDCLVNPQVTRIVAQLLIQGRSL

SEQ ID NO: 769610 - protein, 451 aa, Homo sapiens
MSLQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRKRWHLFPPEDTPFLYPTRIPYEESSVFSKINVVNPDLKRFPQFRKAQRHAVTLSPGQVLFVPRHWWHYVESIDPVTVSINSWIELEEDHLARVEEAITRMLVCALKTAENPQNTRAWLNPTEVEETSHAVNCCYLNAAVSAFFDRCRTSEVVEIQALRTDGEHMKKEELNVCNHMEVGQTGSQNLTTGTDKPEAASPFGPDLVPVAQRSEEPPSERGGIFGSDGKDFVDKDGEHFGKLHCAKRQQIMSNSENAIEEQIASNTTTTPQTFISTDDLLDCLVNPQVTRIVAQLLIQGRSL

SEQ ID NO: 769611 - protein, 488 aa, Homo sapiens; identical to SEQ ID NO: 769609

SEQ ID NO: 769612 - protein, 455 aa, Homo sapiens
MRISCCEQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRKRWHLFPPEDTPFLYPTRIPYEESSVFSKINVVNPDLKRFPQFRKAQRHAVTLSPGQVLFVPRHWWHYVESIDPVTVSINSWIELEEDHLARVEEAITRMLVCALKTAENPQNTRAWLNPTEVEETSHAVNCCYLNAAVSAFFDRCRTSEVVEIQALRTDGEHMKKEELNVCNHMEVGQTGSQNLTTGTDKPEAASPFGPDLVPVAQRSEEPPSERGGIFGSDGKDFVDKDGEHFGKLHCAKRQQIMSNSENAIEEQIASNTTTTPQTFISTDDLLDCLVNPQVTRIVAQLLIQGRSL

SEQ ID NO: 769613 - protein, 66 aa, Homo sapiens
VGAGRESPGLLPVVQLRVSEFGPYSDPTPAPLRLGFRQNPPCGSHGSRLRGDHSCDRCGWGWRGGR

SEQ ID NO: 769614 - protein, 68 aa, Homo sapiens
KRIEDLGPRSLRGPRRQPHRGGESGGLYGERGELKTKRRKKGKKKAHGREGGRGRKEKQERGLSSSEW

SEQ ID NO: 769615 - protein, 711 aa, Homo sapiens
TICFWKQDSRGRVPATADQAPRRTQASTEQAETDDNMDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 769616 - protein, 675 aa, Homo sapiens
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 769617 - protein, 675 aa, Homo sapiens; identical to SEQ ID NO: 769616

SEQ ID NO: 769618 - protein, 655 aa, Homo sapiens [sequence omitted]

SEQ ID NO: 769619 - protein, 632 aa, Homo sapiens
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVKHDHTARHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 769620 - protein, 160 aa, Homo sapiens
MCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 769621 - protein, 542 aa, Homo sapiens
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLLLYLK

SEQ ID NO: 769622 - protein, 498 aa, Homo sapiens
PGHVVRAAGASEEPALLLAHSAPGEESGRTPGAGPVRAARQADEAQRQRGGRGAARRRRRGRGLCLAAPLASDPRAQGSTVERDAAEPPAAMEPAPSAGAELQPPLFANASDAYPSAFPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGRCRLTRPSGPQTPLPSCTRRPHESQWEARAMMWSGASR

SEQ ID NO: 769623 - protein, 79 aa, Homo sapiens
TPPSIGPSMVELKQLISTLTPPLGLQGCGYPCPGAATFPSRQHAWSGHRPSMELALVSVFGVVSQSPHLLIHVLPPARG

SEQ ID NO: 769624 - protein, 236 aa, Homo sapiens
MFREPYLHRSPWGAPDWQPCSWPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQVWC

SEQ ID NO: 769625 - protein, 114 aa, Homo sapiens
AKVCSFTPEASETTNPPGETNNSRRITLRTVTLTAKVCNFTPEPPRPRTHRKEETPNTSEHQKEQTPDTPPLRTVTLTARVRGLFLRSVRPRTHQFWTHHLALLLFTGTKVSNS

SEQ ID NO: 769626 - protein, 88 aa, Homo sapiens
SGRVSSIRFENMNVICGTAGRRNRWLIAVTDFQTRSRLLRSGLSPRGLAHQIVRHDDLLLGDYRLHLRRSLVRRRMLEALGAEPNEEA

SEQ ID NO: 769627 - protein, 35 aa, Homo sapiens
MVRWTRACKRLQGPGRDSSTIKARAETTCEFLFRP

SEQ ID NO: 769628 - protein, 306 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 769629 - protein, 294 aa, Homo sapiens
IRGSGYHGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 769630 - protein, 186 aa, Homo sapiens
MFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGG

SEQ ID NO: 769631 - protein, 238 aa, Homo sapiens
ARHLMLYTSRSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 769632 - protein, 287 aa, Homo sapiens
ARHLMLYTSRSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 769633 - protein, 306 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 769634 - protein, 201 aa, Homo sapiens
MDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 769635 - protein, 306 aa, Homo sapiens; identical to SEQ ID NO: 769633

SEQ ID NO: 769636 - protein, 306 aa, Homo sapiens; identical to SEQ ID NO: 769633

SEQ ID NO: 769637 - protein, 306 aa, Homo sapiens; identical to SEQ ID NO: 769633

SEQ ID NO: 769638 - protein, 294 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGLTIGIKAMATMDITAKVTVVMEDMTTLVTTTTMDMVIIATSRVVMGRYPGEVVIKIATNHTKLFHLQLIPNRW

SEQ ID NO: 769639 - protein, 257 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 769640 - protein, 306 aa, Homo sapiens; identical to SEQ ID NO: 769633

SEQ ID NO: 769641 - protein, 210 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKFNNVIFLF

SEQ ID NO: 769642 - protein, 306 aa, Homo sapiens; identical to SEQ ID NO: 769633

SEQ ID NO: 769643 - protein, 306 aa, Homo sapiens; identical to SEQ ID NO: 769633

SEQ ID NO: 769644 - protein, 306 aa, Homo sapiens; identical to SEQ ID NO: 769633

SEQ ID NO: 769645 - protein, 257 aa, Homo sapiens; identical to SEQ ID NO: 769639

SEQ ID NO: 769646 - protein, 306 aa, Homo sapiens; identical to SEQ ID NO: 769633

SEQ ID NO: 769647 - protein, 257 aa, Homo sapiens; identical to SEQ ID NO: 769639

SEQ ID NO: 769648 - protein, 207 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMGIYRNPWKPLRNGKSG

SEQ ID NO: 769649 - protein, 87 aa, Homo sapiens
WSAAAPLKRGGGESGRRWCLFFFSAAGESGSVRRARVGGEGGRPGRGAGAFAATRAPSLSCVLREVERARGSAGITLLLVSVRGRRV

SEQ ID NO: 769650 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 769651 - protein, 99 aa, Homo sapiens
TLVRGWVRDTETNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 769652 - protein, 257 aa, Homo sapiens; identical to SEQ ID NO: 769639

SEQ ID NO: 769653 - protein, 306 aa, Homo sapiens; identical to SEQ ID NO: 769633

SEQ ID NO: 769654 - protein, 257 aa, Homo sapiens; identical to SEQ ID NO: 769639

SEQ ID NO: 769655 - protein, 306 aa, Homo sapiens; identical to SEQ ID NO: 769633

SEQ ID NO: 769656 - protein, 306 aa, Homo sapiens; identical to SEQ ID NO: 769633

SEQ ID NO: 769657 - protein, 308 aa, Homo sapiens
ARHLMLYTSRSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGVTIGIKAMATMDITAKVTVVMEDMTTLVTTTTMDMVIIATSRVVMGRYPGEVVIKIATNHTKLFHLQLIPNRW

SEQ ID NO: 769658 - protein, 257 aa, Homo sapiens; identical to SEQ ID NO: 769639

SEQ ID NO: 769659 - protein, 257 aa, Homo sapiens; identical to SEQ ID NO: 769639

SEQ ID NO: 769660 - protein, 306 aa, Homo sapiens; identical to SEQ ID NO: 769633

SEQ ID NO: 769661 - protein, 306 aa, Homo sapiens; identical to SEQ ID NO: 769633

SEQ ID NO: 769662 - protein, 257 aa, Homo sapiens; identical to SEQ ID NO: 769639

SEQ ID NO: 769663 - protein, 306 aa, Homo sapiens; identical to SEQ ID NO: 769633

SEQ ID NO: 769664 - protein, 257 aa, Homo sapiens; identical to SEQ ID NO: 769639

SEQ ID NO: 769665 - protein, 124 aa, Homo sapiens
ARHLMLYTSRSAESEGAKIDASKNEEDEGHSNSSPRHSEAATAQREEWKMFIGGLSWDTTKKDPKEQYQQQQQWGSRGGFAGRARGRGGDQQSGYGKVSRRGGHRGEAVFSNLKIHLKVAPATC

SEQ ID NO: 769666 - protein, 160 aa, Homo sapiens
ENTTHNHPPEADSAGTAFNLGPTIKQTETKWEYNNVGTDLSPEPKSFNYPLFSSPGDQFEIQLTQQPRSLIPNNNVRRLISHVIRTLKMDCSETHVQLTCAKLISRTGLLMKLLSEQQEVKVSKAEWDTDQWKTENYINDSTEAQNEQKEQKSSELTKEV

SEQ ID NO: 769667 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769668 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769669 - protein, 293 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRCRTGRSVSSPATASMRPCLLSIRSG

SEQ ID NO: 769670 - protein, 562 aa, Homo sapiens; identical to SEQ ID NO: 769667

SEQ ID NO: 769671 - protein, 552 aa, Homo sapiens
SGNDGPVMFPVALRRENLCEEREGASREFKGRCEAIMDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769672 - protein, 436 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKRNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769673 - protein, 455 aa, Homo sapiens
YSDEAGLSFLIVICRDEKTQMIYQQHHYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769674 - protein, 116 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQAPLVPRAEEPQADVGVL

SEQ ID NO: 769675 - protein, 280 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTPTTRLWARGVALRGTVGVPAFVQGVPKHLLGQRRLSANGDARHSPELGVRLRAH

SEQ ID NO: 769676 - protein, 66 aa, Homo sapiens
SGNDGPVMFPVALRRENLCEEREGASREFKGRCEAIMDAMKRGLCCVLLLCGAVFVSPSQETGPQK

SEQ ID NO: 769677 - protein, 348 aa, Homo sapiens
MDIGWVRAGGIGTEAQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTWGLRQDSKLSSPSRRVFADRFHLGVASCRKGVPGRSGGVPQAGFSWPRSGVSHLRFGHRAGGEFPFPMWDRGFSEVTPAGV

SEQ ID NO: 769678 - protein, 562 aa, Homo sapiens; identical to SEQ ID NO: 769667

SEQ ID NO: 769679 - protein, 562 aa, Homo sapiens; identical to SEQ ID NO: 769667

SEQ ID NO: 769680 - protein, 392 aa, Homo sapiens
MDAMKRGLCCVLLLCGAVFVSPSQEIHARFRRGARSYQVICRDEKTQMIYQQHQSWLRPVLRSNRVEYCWCNNGKTPSLQKLKNKKIKRKPETLLSFRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 769681 - protein, 141 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQAPGVSERWPHDFGGHHQLGPGLWTEGCPGCVHQGYQLPRLDS

SEQ ID NO: 769682 - protein, 1540 aa, Homo sapiens
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSVSFQALCHIANPVMGSADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGKGPPWDGEKGFEDKLSSIPLA

SEQ ID NO: 769683 - protein, 751 aa, Homo sapiens
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGKSELSKRSPPRSSFRSPLPLSFA

SEQ ID NO: 769684 - protein, 617 aa, Homo sapiens
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELYHRKGQFPGITFQNHIIR

SEQ ID NO: 769685 - protein, 112 aa, Homo sapiens
MHRYVHCSTTRNSKDLEPTEMSINDRVDKENVAHIHHGILCSHKKDEFMSFAGTWMKLETIILSKLSQTIVGTENQTPHVLTYKWELNKNTWTQGRELTHPGLLGGGGLRKG

SEQ ID NO: 769686 - protein, 112 aa, Homo sapiens; identical to SEQ ID NO: 769685

SEQ ID NO: 769687 - protein, 131 aa, Homo sapiens
MTPLLTLILVVLMGLPLAQALDCHVCAYNGDNCFNPMRCPAMVAYCMTTRTSAAEAIWCHQCTGFGGCSHGSRCLRDSTHCVTTATRVLSNTEDLPLVTKMCHIGCPDIPSLGLGPYVSIACCQTSLCNHD

SEQ ID NO: 769688 - protein, 116 aa, Homo sapiens
MTPLLTLILVVLMGLPLAQALDCHVCAYNGDNCFNPMRCPAMVAYCMTTRTYYTPTRMKVSKSCVPRCFETVYDGYSKHASTTSCCQYDLCNGTGLATPDTLALAPILLATLWGLL

SEQ ID NO: 769689 - protein, 105 aa, Homo sapiens
MCASFTYFAIFAFSHSSMSAVGESPEAALGMVVTAVTTRTYYTPTRMKVSKSCVPRCFETVYDGYSKHASTTSCCQYDLCNGTGLATPDTLALAPILLATLWGLL

SEQ ID NO: 769690 - protein, 90 aa, Homo sapiens
TGLLLAAVLSLQLAAAEAIWCHQCTGFGGCSHGSRCLRDSTHCVTTATRPRTLSPHSPHSLAPGLTAAPPSRLASPPLPASAATVQHRLS

SEQ ID NO: 769691 - protein, 116 aa, Homo sapiens; identical to SEQ ID NO: 769688

SEQ ID NO: 769692 - protein, 116 aa, Homo sapiens; identical to SEQ ID NO: 769688

SEQ ID NO: 769693 - protein, 93 aa, Homo sapiens
TGLLLAAVLSLQLAAAEAIWCHQCTGFGGCSHGSRCLRDSTHCVTTATRVLSNTEDLPLVTKMCHIGCPDIPSLGLGPYVSIACCQTSLCNHD

SEQ ID NO: 769694 - protein, 155 aa, Homo sapiens
MRHGCCGTHRHAYDETQAGTYRRAAAGDSQARRYLTVVKVTAQALDCHVCAYNGDNCFNPMRCPAMVAYCMTTRTSAAEAIWCHQCTGFGGCSHGSRCLRDSTHCVTTATRVLSNTEDLPLVTKMCHIGCPDIPSLGLGPYVSIACCQTSLCNHD

SEQ ID NO: 769695 - protein, 69 aa, Homo sapiens
VRSVFLLLTREDTGSHLEKTDVEQGEVTPESSHFTLAWVMTCVTLALSRHQHLPHTWEESNELPPGLTS

SEQ ID NO: 769696 - protein, 79 aa, Homo sapiens
DEIQFLRTDDEVVLQCTATIHKEQQKLCLAAEGFGNRLCFLESTSNSKNVPPDLSICTFVLEQSLSVRALQEMLANTVE

SEQ ID NO: 769697 - protein, 48 aa, Homo sapiens
MESSGHAAAMEPEACGAGRARGVLALLLRGAGEGPVSPGWAGARMTEH

SEQ ID NO: 769698 - protein, 46 aa, Homo sapiens
MSGSGELGAAGLESDEYRQQQEATVTTNLHTLTTVISYCPKISSQC

SEQ ID NO: 769699 - protein, 159 aa, Homo sapiens
MYPQNNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 769700 - protein, 111 aa, Homo sapiens
LARSLPLGEAKQWFVVSIIIVVLLSHCYFLPCGHGQACAPTSFYCCLLGKHQAHGSTPLARRQCTSMFTFSTKYTDRAGCSWLMSVIPALWEAEVGGSPEVRSSIPAWPTW

SEQ ID NO: 769701 - protein, 472 aa, Homo sapiens
MNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 769702 - protein, 113 aa, Homo sapiens
MSPERQGGELTLSLLDLQLGPLGRDPPQECSTFSPTDSGEEPGQLSPGVQFQRRQNQRRFSMEDVSKRLSLPMDIRLPQEFLQKLQMESPDLPKPLSRMSRRASLVSPKRVRG

SEQ ID NO: 769703 - protein, 550 aa, Homo sapiens
SGFLPPPPPPPPPSSSPPSSTPSLPLPFYLLLGQLRLQLLWGTAHLSGAGEAAPCPGGSGRTAAPRTRADPAAQSLMIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 769704 - protein, 502 aa, Homo sapiens
MNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 769705 - protein, 499 aa, Homo sapiens
RLSSSSSSSSSSLLFPTFLHSLPSPPLLPPPRPAQVAASLGNCSPFRSRGSCPVPGRERAHRGPQDTRYLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 769706 - protein, 429 aa, Homo sapiens
SGFLPPPPPPPPPSSSPPSSTPSLPLPFYLLLGQLRLQLLWGTAHLSGAGEAAPCPGGSGRTAAPRTRADPAAQSLMIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKVRPQGQGPPILAATCPEAQCGDPLSPPGIRLLRWLRPSHVGKRERAMPSTSPGTGLSALPQEQTHTVCHCLAVGIKPTLNSEHQFPSLSNGSVSYLPKCREASGEARGYE

SEQ ID NO: 769707 - protein, 429 aa, Homo sapiens; identical to SEQ ID NO: 769706

SEQ ID NO: 769708 - protein, 550 aa, Homo sapiens; identical to SEQ ID NO: 769703

SEQ ID NO: 769709 - protein, 550 aa, Homo sapiens; identical to SEQ ID NO: 769703

SEQ ID NO: 769710 - protein, 429 aa, Homo sapiens; identical to SEQ ID NO: 769706

SEQ ID NO: 769711 - protein, 429 aa, Homo sapiens; identical to SEQ ID NO: 769706

SEQ ID NO: 769712 - protein, 550 aa, Homo sapiens; identical to SEQ ID NO: 769703

SEQ ID NO: 769713 - protein, 550 aa, Homo sapiens; identical to SEQ ID NO: 769703

SEQ ID NO: 769714 - protein, 550 aa, Homo sapiens; identical to SEQ ID NO: 769703

SEQ ID NO: 769715 - protein, 157 aa, Homo sapiens [sequence omitted]

SEQ ID NO: 769716 - protein, 157 aa, Homo sapiens [sequence omitted]

SEQ ID NO: 769717 - protein, 429 aa, Homo sapiens; identical to SEQ ID NO: 769706

SEQ ID NO: 769718 - protein, 125 aa, Homo sapiens
AVVGETHRKCVTTPPTARTELAVVAAPRRCRSSLLPHTRSHAAAGALDREVGAIHPPRARAQSLLPRQVWNPPSPLWSEEVYSTAPYYTSWARGPRCPPELCAPPLKRKEQTEPTPSVRFFPSPL

SEQ ID NO: 769719 - protein, 151 aa, Homo sapiens
GRPPHKGAPRLGRGVGALVPAPRAGSHPPAGVCASVHRNAVGAGGPARAGQPGLDGTGRRGARAGGERPEGRAPKVWNPPSPLWSEEVYSTAPYYTSWARGPRCPPELCAPPLKRKEQTEPTPSVRHPTMMRYLVEQTNSATENDESCLKK

SEQ ID NO: 769720 - protein, 143 aa, Homo sapiens
GRPPHKGAPRLGRGVGALVPAPRAGSHPPAGVCASVHRNAVGAGGPARAGQPGLDGTGRRGARAGGERPEGRAPKVWNPPSPLWSEEVYSTAPYYTSWARGPRCPPELCAPPLKRKEQTEPTPSVSTIHNSQEVEAAQMFINR

SEQ ID NO: 769721 - protein, 104 aa, Homo sapiens
MSLFPPPASADRGPPARPRRPPHPRPSLLLRFPFSPVLGSDIRGRRGRQPKQPAASAAERCAPAPAPAPAPAPPKSWTQSEERLRLCWNQKRQQGARRGQEKDK

SEQ ID NO: 769722 - protein, 134 aa, Homo sapiens
EPGGKTFIVGDQISFADYNLLDLLPWLLVSVIHACVFFKTYDRPLILQLQLLWNVFLLHISCDALITGHSIVGFAMYYFTYDPWIGKLLYLEDFFVMSDYRGFGIGSEILKNLSQVAMRVSLQQHALSVVARME

SEQ ID NO: 769723 - protein, 72 aa, Homo sapiens
MINEGHSIVGFAMYYFTYDPWIGKLLYLEDFFVMSDYRVRHRIKFLKESYARFAMKCRLQAIQLPSGWQNLD

SEQ ID NO: 769724 - protein, 94 aa, Homo sapiens
MVLGEHPFYHCLVAEVPKEHWTPEGNPSPFPEARETKCYVRSSVGCVEPLTTQAEVTENLDRKNSQQVFKLLRKKKKVDAAANLVVVVAAVGGR

SEQ ID NO: 769725 - protein, 192 aa, Homo sapiens [sequence omitted]

SEQ ID NO: 769726 - protein, 208 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 769727 - protein, 244 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSVSTGGTSSSFISMFDLNSCLFSGLKRARNATESVWKEKLTQECVFREQFEENWYNTYSSNLYKHVDTGRRYYVALNKDGTPREGTRTKRHQKFTHFLPRPVDPDKVPELYKDILSQS

SEQ ID NO: 769728 - protein, 149 aa, Homo sapiens
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRV

SEQ ID NO: 769729 - protein, 58 aa, Homo sapiens
GTCVRARPLPARCPAEQPRLNGAGLAGRSTPVLHPPSPLTRTQLLPARGHMKTSDKWG

SEQ ID NO: 769730 - protein, 161 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 769731 - protein, 161 aa, Homo sapiens; identical to SEQ ID NO: 769730

SEQ ID NO: 769732 - protein, 161 aa, Homo sapiens; identical to SEQ ID NO: 769730

SEQ ID NO: 769733 - protein, 161 aa, Homo sapiens; identical to SEQ ID NO: 769730

SEQ ID NO: 769734 - protein, 163 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQVRKWHDPWGQPGL

SEQ ID NO: 769735 - protein, 255 aa, Homo sapiens
MAASHFTGLTAVADVIKDLDTQIALIGLGPHSSKKKQDLDKLYELKSKARQIMNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWTCGVQDWFENRAKKVAKKYNRDALSEQPITGAGWARLELGKPTPGFGSQAILGDMGGETQSQRKNFQTGESRVLTSGRS

SEQ ID NO: 769736 - protein, 212 aa, Homo sapiens
FYSQDSSFITGSSRANSCAFLLQLIGLGPHSSKKKQDLDKLYELKSKARQIMNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 769737 - protein, 147 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPRNNTRKGQGMDSNVFGDT

SEQ ID NO: 769738 - protein, 194 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQMLLLWAGIMCLPLTAVKSRCQLTSAMTSATDSLCNLGPNLRDHP

SEQ ID NO: 769739 - protein, 161 aa, Homo sapiens; identical to SEQ ID NO: 769730

SEQ ID NO: 769740 - protein, 203 aa, Homo sapiens
VKGQSRVDAEQEKLLIGLGPHSSKKKQDLDKLYELKSKARQIMNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 769741 - protein, 75 aa, Homo sapiens
MCRQVMSTLPRGGVTFLTNLERKWQHLEQNNFAMKEFIATKSQESDYQPIKKNVTKQIAEYNKTIVDALHSTSGN

SEQ ID NO: 769742 - protein, 853 aa, Homo sapiens [sequence omitted]

SEQ ID NO: 769743 - protein, 86 aa, Homo sapiens
IVIFEFYVLACMDRKICKIQWLAQDDIVFDESGVKLLQLSAAAVDKGCSVGEVLQSVLRYEKERQLNEAVGNVTPLQLLDWLMVNL

SEQ ID NO: 769744 - protein, 335 aa, Homo sapiens
TTPVKPTEPCTPSKSRSASSEEASESPTARQIPPEARRLIVNKNAGETLLQRAARLGYKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 769745 - protein, 726 aa, Homo sapiens
MLVAGHGGSHLYIPALWEAEAGGSFDVQEFETNLANMVKPHLYYNTKISQAWSWVPVIPATQEAETGELLEPEEVEVAVSRDCATALQPRDSVLEKEKKEKKTVMVTEDPVRVGGGAEELTLGKGKPVRRLTRQSPGQKWQRLELGQWNSEEGKPCELGPLMWGGSVSSRISQCKRLARDRPLQHPSQLSPGCHPVGCAQQSQTPLSECELWPCRNDGAAAGEKTCLMHSRAKEKCLLDYPQFRPFSTAPPLLGKILESKEAREARVRTGEGKAARVGRGGSRRKDWSQQMANAKVTGAQAKSPRSLLRVLGSRMPLCLLFVLFWKRWSLIACSPFELKAGPGIAGDRRRHLPQLYPRSLWFSRGRGSQTGSEFIMGDIDGRAAFVGFAECSGSVPPPLPPASFNNSHPCLCRPCNWFLFSDVLKRLKLSSRIFQARFPHFEITTMPKAEFYRQVASSQLLTPAERPGGLDDRSPPGSSETVELVRYEPDLLRLLGSEVEFQSCNSDRENSPSSSFSFRVRPSPTSLSFPDRAPDCRMRQEYGPTRSRLINASISDWTVFVFLVTISSHLPVVVIVIVVADGGGKLNSMSEDKRSREVVGGGAGVPWTGLLVHDQDQTWALDGLGLSRGEMRKSQISERPPTPFPCVLLSSVVFILLVFNLYVFHWFLISLYHCDDLRQLVVLRDFLYLLFFFFVDELLTKLFPGVFFPHWGGGEVEWGGGTWTCD

SEQ ID NO: 769746 - protein, 210 aa, Homo sapiens
SITALAPSRLPPITSTVSSLGYSRENRAGELDVAKVHCPPWRQKPKTSPACPPLAAVPGGKRQRSGAGCPVLAMRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVIEITIYEDRGMSSGR

SEQ ID NO: 769747 - protein, 137 aa, Homo sapiens
MRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVIEITIYEDRGMSSGR

SEQ ID NO: 769748 - protein, 137 aa, Homo sapiens; identical to SEQ ID NO: 769747

SEQ ID NO: 769749 - protein, 137 aa, Homo sapiens; identical to SEQ ID NO: 769747

SEQ ID NO: 769750 - protein, 137 aa, Homo sapiens; identical to SEQ ID NO: 769747

SEQ ID NO: 769751 - protein, 290 aa, Homo sapiens
AEGGVGPGPAHIISLPRPSPTARSFGRVALRPEERVGPRPEVGGRAEGRGRGFLRQDVSDGEGGATAAGGQRRRVCVSRAEPGCGGRGAWARRQLRPAVTAWVKGSGAEEALGCFRRRVGARGWRVRVPGPGRGSDSRLVFPRPRSAGCPVLAMRPQQAPVSGKVFIQRDYSSGTRCQFQTKFPAELENRIDRQQFEETVRTLNNLYAEAEKLGGQSYLEGCLACLTAYTIFLCMETHYEKVLKKVSKYIQEQNEKIYAPQGLLLTDPIERGLRVIEITIYEDRGMSSGR

SEQ ID NO: 769752 - protein, 137 aa, Homo sapiens; identical to SEQ ID NO: 769747

SEQ ID NO: 769753 - protein, 290 aa, Homo sapiens; identical to SEQ ID NO: 769751

SEQ ID NO: 769754 - protein, 210 aa, Homo sapiens; identical to SEQ ID NO: 769746

SEQ ID NO: 769755 - protein, 104 aa, Homo sapiens
AEGGVGPGPAHIISLPRPSPTARSFGRVALRPEERVGPRPEVGGRAEGRGRGFLRQDVSDGEGGATASVPTSSPEHHSFLSAARATVPFTPRTHFLKFHTWSDL

SEQ ID NO: 769756 - protein, 137 aa, Homo sapiens; identical to SEQ ID NO: 769747

SEQ ID NO: 769757 - protein, 144 aa, Homo sapiens
APPRCARPRLRAKQQAGLGGDVRGRGNWSFFSVYFGIQFLFFFVLTQEKISIAFSIWKATLLLPEPQSCVVGGCCGWHLGRPRPPRREDVRPCLLPPLPGESSRARPSLALRPLGVLPCCFKSGSCLKNPKKKSSQMTLCPTLR

SEQ ID NO: 769758 - protein, 119 aa, Homo sapiens
GPSAPCTFNAVGLPAALEGQSYPDATVVSRQPWEGQSYPDATVVSRQPWEGQSYPDATAELPFPPCCPQGRLLVSSDAGRRNPPAPESLARTRPGGAGAKTQRMWPPSLVTDGYQGGFG

SEQ ID NO: 769759 - protein, 119 aa, Homo sapiens; identical to SEQ ID NO: 769758

SEQ ID NO: 769760 - protein, 119 aa, Homo sapiens; identical to SEQ ID NO: 769758

SEQ ID NO: 769761 - protein, 181 aa, Homo sapiens
MSTESMIRDVELAEEALPKKTGGPQGSRRCLFLSLFSFLIVAGATTLFCLLHFGVIGPQREEFPRDLSLISPLAQAVSIIFSQNRSCTQCYNSAVKKTSQCSAREPQLRPTRTRATANTCAHSAPPAQTCSSKHRARALHTQHCYTYTALIFKRAQRATLHNTAAYSTQHTSTTHRTLIPK

SEQ ID NO: 769762 - protein, 211 aa, Homo sapiens
MNGERKPDTSGLRAQARQAASCSSFKGDSLDVNHSPSPQQFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 769763 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 769764 - protein, 179 aa, Homo sapiens [sequence omitted]

SEQ ID NO: 769765 - protein, 178 aa, Homo sapiens
RLTLFCNFLFMSLEATKWWEIRDSNIWWPCDVSKLLDFSQFPFPIKWVVLGIRGSNSAGNRGRNRQLRPRTSPKPRAATGTTVRGASVKRTGGPAPAQPSPPGPLPPTPHGPHARAETGASPGSPVRQPLPGPAPQREAAWGRRRVERAAEDKEEVAVENKKELSAVCPDAGRRWGQA

SEQ ID NO: 769766 - protein, 681 aa, Homo sapiens
PGEPARRRPRARARAAMYRRSYVFQTRKEQYEHADEASRAAEPERPADEGWAGATSLAALQGLGERVAAHVQRARALEQRHAGLRRQLDAFQRLGELAGPEDALARQVESNRQRVRDLEAERARLERQGTEAQRALDEFRSKYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 769767 - protein, 540 aa, Homo sapiens
MYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 769768 - protein, 681 aa, Homo sapiens; identical to SEQ ID NO: 769766

SEQ ID NO: 769769 - protein, 536 aa, Homo sapiens
PGEPARRRPRARARAAMYRRSYVFQTRKEQYEHADEASRAAEPERPADEGWAGATSLAALQGLGERVAAHVQRARALEQRHAGLRRQLDAFQRLGELAGPEDALARQVESNRQRVRDLEAERARLERQGTEAQRALDEFRSKYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 769770 - protein, 299 aa, Homo sapiens
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 769771 - protein, 272 aa, Homo sapiens
MHMGVRTWPAPSCLCPTCAHELDPDREYGSTLVRTCHVPRGLVEICVMNPREMCGEYTRVIVIKREVNAWHVFMVETRKEQLKTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 769772 - protein, 299 aa, Homo sapiens; identical to SEQ ID NO: 769770

SEQ ID NO: 769773 - protein, 112 aa, Homo sapiens
VQAGMSHSTRQRCQDTNTTRERGLCNCTCVNSGTIYHQYKTEKHNCGEYPGDAKGSDSSQWILLECFLFFFSEAGLALLPRLHLNFRAQLNLPSSRDYRCVPLHPALCIVYC

SEQ ID NO: 769774 - protein, 112 aa, Homo sapiens; identical to SEQ ID NO: 769773

SEQ ID NO: 769775 - protein, 99 aa, Homo sapiens
REPVAPSLEKESGRGEWLSGRGEWLSGSISSEEEAAAAAAFTERKNSLKIPFETLKKHHLFSFGKWHMDGTGSHYPQQTNTGTKKPNTTFSHLQMGAEQ

SEQ ID NO: 769776 - protein, 241 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDNTSEA

SEQ ID NO: 769777 - protein, 213 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKVRLTPLTP

SEQ ID NO: 769778 - protein, 249 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDKSREASELSKFIY

SEQ ID NO: 769779 - protein, 141 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLG

SEQ ID NO: 769780 - protein, 89 aa, Homo sapiens
AAARARARVGRLALYASPGICGLRAPPPPPALSWSPAPAAAARAGGCGAQERPRLRPGPAQGESGAVRSRVGSGPLPGGAWSGGGGGGR

SEQ ID NO: 769781 - protein, 223 aa, Homo sapiens
RPPGPGPASGAWLCTRARGSAAFVPPLPRPPSRGARRRRRLPGRGVAALRRGPGSAPGLPRGRAERSAAGSGRGPSREERGAAAAAAAAEMMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPILTSVMLAKPRLDTEQLA

SEQ ID NO: 769782 - protein, 145 aa, Homo sapiens
MVSQPTFSFSAEMMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPILTSVMLAKPRLDTEQLA

SEQ ID NO: 769783 - protein, 223 aa, Homo sapiens; identical to SEQ ID NO: 769781

SEQ ID NO: 769784 - protein, 175 aa, Homo sapiens
AAARARARVGRLALYASPGICGLRAPPPPPALSWSPAPAAAEMMEELHSLDPRRQELLEARFTGVGVSKGPLNSESSNQSLCSVGSLSDKEVETPEKKQNDQRNRKRKAEPYETSQGKGTPRGHKISDYFERRVEQPLYGLDGSAAKEATEEQSALPILTSVMLAKPRLDTEQLA

SEQ ID NO: 769785 - protein, 130 aa, Homo sapiens
ETPPFPPPEPAYITWKTRDQPATHTTQEPSGAPAHLAQCCHCQQPKKPPGGPGIGPRRQAIISAHKHCPWSLVLTHQVYHHLPLMVKDKTSWASPSSAKSSPQPPINNYSLGQVLVGFKAVNFPGIFEEG

SEQ ID NO: 769786 - protein, 392 aa, Homo sapiens
MSLAHTAAEYMLSDALLPDRRGPRLKGLRLELPLDRIVKFVAVGSPLLLMSLAFAQEFSSGSPISCFSPSNFSIRQAAYVDSSCWDSLLHHKQDGPGQDKMKSLWPHKALPYSLLALALLMYLPVLLWQYAAVPALSSDLLFIISELDKSYNRSIRLVQHMLKIRQKSSDPYVFWNELEKARKERYFEFPLLERYLACKQRSHSLVATYLLRNSLLLIFTSATYLYLGHFHLDVFFQEEFSCSIKTGLLSDETHVPNLITCRLTSLSIFQIVSLSSVAIYTILVPVIIYNLTRLCRWDKRLLSVYEMLPAFDLLSRKMLGCPINDLNVILLFLRANISELISFSWLSVLCVLKDTTTQKHNIDTVVDFMTLLAGLEPSKPKHLTNSACDEHP

SEQ ID NO: 769787 - protein, 261 aa, Homo sapiens
MSDEEVEQVEEQYEEEEEAQEEAAEVHEEVHEPGGRSEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 769788 - protein, 68 aa, Homo sapiens
VTAFVKVDKAKELWETLHQLEIDKFEFGEKLKRQKYDIMNVRARVQMLAKFSKKAGTPAKGKVGGRWK

SEQ ID NO: 769789 - protein, 154 aa, Homo sapiens
MSDEEVEQVEEQYEEEEEAQEEAAEVHEEVHEPEDDLKKKKALSSMGANYSSYLAKADQKRGKKQTAREMKKKILAERRKPLNIDHLGEDKLRDKAKELWETPQSCQGLPDSPGGGEAIPGRPPRLCPCCLHPLGPVNKAAEPPTKKQTTTHTK

SEQ ID NO: 769790 - protein, 335 aa, Homo sapiens
GLAEMRMSPSFTLQGAQASFPAAGSCLAAEYILITVSVPCSLKPASPAPGSPALQYEEEEEAQEEAAEVHEEVHEPGGRRRGETETQPHWLFSCMCACAFCHLEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 769791 - protein, 261 aa, Homo sapiens; identical to SEQ ID NO: 769787

SEQ ID NO: 769792 - protein, 261 aa, Homo sapiens
MSDEEVEQVEEQYEEEEEAQEEAAEVHEEVHEPGGRSEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDIMNVRARVQMLAKFSKKAGTPAKGKVGGRWK

SEQ ID NO: 769793 - protein, 254 aa, Homo sapiens
MSDEEVEQVEEQYEEEEEAQEEAAEVHEEVHEPGGRSEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDASPPPGLSEEPLTGLWGLEDVESH

SEQ ID NO: 769794 - protein, 216 aa, Homo sapiens
SACSRCCPQGAPALLTLDPQKPPTFTMSDEEVEQVEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPRAARGTPHPPAPTILSGAP

SEQ ID NO: 769795 - protein, 270 aa, Homo sapiens
SACSRCCPQGAPALLTLDPQKPPTFTMSDEEVEQVEEEAQEEEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 769796 - protein, 109 aa, Homo sapiens
MGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 769797 - protein, 249 aa, Homo sapiens
MSDEEVEQVEEQYEEEEEAQEEAAEVHEEVHEPGGRSEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDRAARGTPHPPAPTILSGAP

SEQ ID NO: 769798 - protein, 144 aa, Homo sapiens
SACSRCCPQGAPALLTLDPQKPPTFTMSDEEVEQVEEEAQEEEEVQEEEKPRPKLTAPKIPEGEKVDFDDIQKKRQNKDLMELQALIDSHFEARKKEEEELVALKERIEKRRAERAEQQRIRAEKERERQNRLARTRLHIFCSY

SEQ ID NO: 769799 - protein, 341 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRPDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 769800 - protein, 341 aa, Homo sapiens; identical to SEQ ID NO: 769799

SEQ ID NO: 769801 - protein, 88 aa, Homo sapiens
RAAGEGFRAQPPSPGSAEAGAVGGSFPRSSDHSKDHGLDMSGSGSWELLAWSLDEYRQQPKATVTTNLHTLTTVISYCPKISSQCKKT

SEQ ID NO: 769802 - protein, 795 aa, Homo sapiens
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 769803 - protein, 1158 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 769804 - protein, 1105 aa, Homo sapiens
MQRVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 769805 - protein, 1144 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 769806 - protein, 1158 aa, Homo sapiens; identical to SEQ ID NO: 769803

SEQ ID NO: 769807 - protein, 1158 aa, Homo sapiens; identical to SEQ ID NO: 769803

SEQ ID NO: 769808 - protein, 100 aa, Homo sapiens
SCLFSPQPEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 769809 - protein, 610 aa, Homo sapiens
GRHCPAFGESGGPFGWSASLVWGSPQALSFTGRSSMDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 769810 - protein, 172 aa, Homo sapiens
GRHCPAFGESGGPFGWSASLVWGSPQALSFTGRSSMDPEDEGVAGVMSVGPPAARLQVTITTITTAAGSGQASPAQTDPFTSRRDESGTAVNALDTWGNSDAGRGVVTVLAGQRGGRDSNQAPGPRMRMLHAALSSPGLGSVIPERIEQAHLLRSAPPRRHPCPFQEGLSSC

SEQ ID NO: 769811 - protein, 559 aa, Homo sapiens
MCVMFQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 769812 - protein, 160 aa, Homo sapiens
LCCNLGALGSVFRPLGVRPLLCWGIRSAPKLPGKHSGGVASKNSGWAAEAAQCTHSCRNNQTGALGGAACRGSRRTYAPQSRRKDRPALSWLTGKLRSDGEPWGIGAYSHLPLQLPCTQNPLGSLQPGALSLPTPWADPPANSTVCGGHRISYSWDPRNT

SEQ ID NO: 769813 - protein, 693 aa, Homo sapiens
MAALGVQSINWQKAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWDGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLKNLSRDTKTVTVNMTAWTIIYNGTLVHEVWKDSATMSLDPEEEAEHPIKISYAQYEKYLKSDNMIRITAVCKVPDESEVVVERDIILDNPTLTLEVLNEARVRKPVNVQMLFSNPLDEPVRDCVLMVEGSGLLLGNLKIDVPTLGPKERSRVRFDILPSRSGTKQLLADFSCNKFPAIKAMLSIDVAE

SEQ ID NO: 769814 - protein, 693 aa, Homo sapiens; identical to SEQ ID NO: 769813

SEQ ID NO: 769815 - protein, 76 aa, Homo sapiens
ALANDSRSVRPGGGGALMATAGLSTLRTGLGSGPVARNPPRPCRAERAPRFSYPPLVNPAQRETKARAPGPARPGQ

SEQ ID NO: 769816 - protein, 388 aa, Homo sapiens
MSILKIHARELFDSRGNPTVEVDLFTSEGLFRAAVPSGASTGIYEVLELQDNDKTRYMGKGVSKPVEPINKTIAPVLVSKKLNVTEQEKIDKLMIEMDGTENKSKFGANAILGVSLAACKASAVEKGVPLYHHIADLSGNSKVILPVPVFNVINGSSHAVTKLAMQEFMVLPVGAANFREAMPIGAEVYHSLKNVIKEKYGKDATGVGDGGAFAPNILENKEGLELLKTAIGKAGYTDKVIVSMDVEASEFFRSGKYDLEFKFLDDPTRYISPDCLADLYKSFIKNYPVVSTEDPFDQDDWGAWQKFTASAGIQVVEDDLRVTNPKRTASAVNEKKCNCLLLKVNQIRSVTESLQACKLAQANGWCVMVPHHSGETENTFITDLVVGL

SEQ ID NO: 769817 - protein, 118 aa, Homo sapiens
MSPANSTEALRPANCHDLPMPGHRKSSGRGRCMSKDKEWDTDCYIIKEKDCQIKSLAVNQAWWQIPVIPAIREAEAGDIACTREAEVAVELRPRHGLLPDDKRRIYVSTNNNTLGHWY

SEQ ID NO: 769818 - protein, 271 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGCRQHMFYRVFI

SEQ ID NO: 769819 - protein, 147 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDVVKQLLITGGILACIMPCCYC

SEQ ID NO: 769820 - protein, 556 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 769821 - protein, 537 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGLSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 769822 - protein, 500 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNEMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 769823 - protein, 512 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGKSQHPVPF

SEQ ID NO: 769824 - protein, 556 aa, Homo sapiens; identical to SEQ ID NO: 769820

SEQ ID NO: 769825 - protein, 240 aa, Homo sapiens
MQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 769826 - protein, 556 aa, Homo sapiens; identical to SEQ ID NO: 769820

SEQ ID NO: 769827 - protein, 556 aa, Homo sapiens; identical to SEQ ID NO: 769820

SEQ ID NO: 769828 - protein, 512 aa, Homo sapiens; identical to SEQ ID NO: 769823

SEQ ID NO: 769829 - protein, 564 aa, Homo sapiens
AAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGDKQASLLIPGAKPALATAQRAAAAATAPYGDVLDRQAPSPRPSSSVFVRQLNLYPKLPFL

SEQ ID NO: 769830 - protein, 60 aa, Homo sapiens
KVARVLPFPHGPPQSLLQRHGGLPPGQGSENWAVNQCSQSQSVSPPSIPGPPGPNTWLLS

SEQ ID NO: 769831 - protein, 210 aa, Homo sapiens
LLGRFISPRARSAFLEAGRTRPGHRTGFAPLAPQSGPRGRATGHCCLLKRHKAPSFLRPRRPNALALADSEHPLRVRTHCSAPGHAPQSAQRPPGRGTARGRPESPAVPVSAAGGRDFPAGPRPLPGPLLYAGPRAGTAVLDRPQPTVLRRPRVGRQQPPSPEAAVPSAGAPRAPRPACAPALRLGTMVQAGGVTGRDATGGTGPSTRTS

SEQ ID NO: 769832 - protein, 70 aa, Homo sapiens
TVRLETSSPQFQGRCRLRAVRGSRADWDSGDVPPTPPPFTLSLQGREQNKDGYIFHLTSEPRLGKRCSPD

SEQ ID NO: 769833 - protein, 62 aa, Homo sapiens
ALWGGPGVSPQTPVGARAAPSDLQDVECGGHPGGGDGTLLFAGARPPVRLAAGDHRDLAWCR

SEQ ID NO: 769834 - protein, 134 aa, Homo sapiens [sequence omitted]

SEQ ID NO: 769835 - protein, 227 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 769836 - protein, 227 aa, Homo sapiens; identical to SEQ ID NO: 769835

SEQ ID NO: 769837 - protein, 227 aa, Homo sapiens; identical to SEQ ID NO: 769835

SEQ ID NO: 769838 - protein, 177 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIWVVGQNFLPFLQVIPIIIPWEPFPKRPLREPI

SEQ ID NO: 769839 - protein, 227 aa, Homo sapiens; identical to SEQ ID NO: 769835

SEQ ID NO: 769840 - protein, 227 aa, Homo sapiens; identical to SEQ ID NO: 769835

SEQ ID NO: 769841 - protein, 227 aa, Homo sapiens; identical to SEQ ID NO: 769835

SEQ ID NO: 769842 - protein, 227 aa, Homo sapiens; identical to SEQ ID NO: 769835

SEQ ID NO: 769843 - protein, 86 aa, Homo sapiens
VTLRITLPGPSPHSSVYLIIPAHITKPKEHKKLFLVQLQEKALFAVPKNYKLVAAPLFELYDNAPGYGPIISSLPQLLSRFNFIYN

SEQ ID NO: 769844 - protein, 227 aa, Homo sapiens; identical to SEQ ID NO: 769835

SEQ ID NO: 769845 - protein, 227 aa, Homo sapiens; identical to SEQ ID NO: 769835

SEQ ID NO: 769846 - protein, 227 aa, Homo sapiens; identical to SEQ ID NO: 769835

SEQ ID NO: 769847 - protein, 388 aa, Homo sapiens
TSCPRPLQEGTPGSRAAHALSRRGHRVHELPTSSPGGDTGFMSCPRPFQEGTPGSRAAHVLSRKGPRVHELPTSSPGRDPGSTSCPRPLQEGTRVHELPTSSPGRDPGFTSCPRPLQEGTPGSRAAHALSRKGPRVHELPTSSPGRDPGHELPTPSPGGDPGPRAAHVVSRKGPGSTSCPRPLQEGTRVHELPTRSPGGDTGFTSCPRPLQEGTPGSRAAHVLSRRGHRVHELPTSSPGGDTGFTSCPRPLQEGTPGSRAAHVLSRKGPGSTSCPRPLQEGTPGSRAAHALSRKGPRVQVSCRPTSCLCVNQKKDEEQALLSLQAGFGGGAGSPAAPSLAGHPVLEPQNCRRPAEKGSMMAPRCAALDLPPWTWRQGFSSLARLVSNS

SEQ ID NO: 769848 - protein, 144 aa, Homo sapiens
MTVLEITLAVILTLLGLAILAILLTRWARRKQSEMHISRYSSEQSARLLDYEDGRGSRHAYSTQSDTSCDNRERSKRDYTPSTNSLVSMASKFSLGQTELILLLMCFILALSRSSIGSIKCLQTTEELPSRTAGAMMQFTAPIP

SEQ ID NO: 769849 - protein, 114 aa, Homo sapiens
WRRGSHWCGPGRERRGWFIGSVTVTGTLQLRGSPPASASCVGGTPGPCHCTQLMMLVLEMGVAIPRVECLWGSWGMVVGVINSTEVFIFIKWILIPKQITDVLLLDRRWYGKTG

SEQ ID NO: 769850 - protein, 1279 aa, Homo sapiens
AEPQALPEPRALERLSARWQAGARSPGLGRAERSAGTRRSGPRGSAGAGRQVCRRRAARAQAAPGRGPRSEGRREASEDPRPQSSLCAPVLAWRGAGPAPATRSLVRRRVGGPARRHGLRMPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 769851 - protein, 1008 aa, Homo sapiens
AEPQALPEPRALERLSARWQAGARSPGLGRAERSAGTRRSGPRGSAGAGRQVCRRRAARAQAAPAAAGGPEGRREASEDPRPQSSLCAPVLAWRGAGPAPATRSLVRRRVGGPARRHGLRMPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGMGWGAGTGLEMPSAASRGASLLNMQSLGLWTWDCLQGHWAPLIHLNSGPPSGAMERSPTWGEAAELWGSHILLPFRIRHKQTLFASLK

SEQ ID NO: 769852 - protein, 951 aa, Homo sapiens
AEPQALPEPRALERLSARWQAGARSPGLGRAERSAGTRRSGPRGSAGAGRQVCRRRAARAQAAPAAAGGPEGRREASEDPRPQSSLCAPVLAWRGAGPAPATRSLVRRRVGGPARRHGLRMPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGMGWGAGTGLEMPSAASRGASLLNMQSLGLWTWDCLQGHWAPLIHLNSGPPSGAMERSPTWGEAAELWGSHILLPFRIRHKQTLFASLK

SEQ ID NO: 769853 - protein, 420 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATLCCAKLYYCMFFQ

SEQ ID NO: 769854 - protein, 390 aa, Homo sapiens
AEPQALPEPRALERLSARWQAGARSPGLGRAERSAGTRRSGPRGSAGAGRQVCRRRAARAQAAPAAAGGPEGRREASEDPRPQSSLCAPVLAWRGAGPAPATRSLVRRRVGGPARRHGLRMPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVVDVDLTDPTENQTEKSTWTLRQKLTDQMDKTQWTGTYEDTSKKEADEIDRHGWGNTRGNITENTNIHDRHTETKTTTNEPQRDDTKTSKPQERHISEKYKTGKHMNTTGILYDITQRIKELTTSTDESTEER

SEQ ID NO: 769855 - protein, 58 aa, Homo sapiens
MCPFPVPQLIGLLKTARLLRLVRVARKLDRYSEYGAAVLFLLMCTFALIAHWLACIWY

SEQ ID NO: 769856 - protein, 284 aa, Homo sapiens
AEPQALPEPRALERLSARWQAGARSPGLGRAERSAGTRRSGPRGSAGAGRQVCRRRAARAQAAPAAAGGPEGRREASEDPRPQSSLCAPVLAWRGAGPAPATRSLVRRRVGGPARRHGLRMPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGKCTCFR

SEQ ID NO: 769857 - protein, 819 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 769858 - protein, 367 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQPHLPASPSPASTQHSSNTS

SEQ ID NO: 769859 - protein, 69 aa, Homo sapiens
LKLGLEPLFDNGEKCSSVYRVWAILRGTDSNCMAFIVLICLWETGIFSRKNRPDLELFQLEILGNRRIT

SEQ ID NO: 769860 - protein, 260 aa, Homo sapiens
VIGEGLWEGGGRQGGGGAREGKVEPEGRRRDLRRGDFYRKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREE

SEQ ID NO: 769861 - protein, 152 aa, Homo sapiens [sequence omitted]

SEQ ID NO: 769862 - protein, 85 aa, Homo sapiens
QRGARVLWTPKEFNSDWPAEGRDRKGVSMQACRFYKMASSLVKTAQKACLRNRPAADTPRSEGTGDHGKASKMTSLAGGTRQSSR

SEQ ID NO: 769863 - protein, 496 aa, Homo sapiens
MVEADHPGKLFIGGLNRETNEKMLKAVFGKHGPISEVLLIKDRTSKSRGFAFITFENPADAKNAAKDMNGKSLHGKAIKVEQAKKPSFQSGGRRRPPASSRNRSPSGSLRSARGSRGGTRGWLPSHEGHLDDGGYTPDLKMSYSRGLIPVKRGPSSRSGGPPPKKSAPSAVARSNSWMGSQGPMSQRRENYGVPPRRATISSWRNDRMSTRHDGYATNDGNHPSCQETRDYAPPSRGYAYRDNGHSNRDEHSSRGYRNHRSSRETRDYAPPSRGHAYRDYGHSRRDESYSRGYRNRRSSRETREYAPPSRGHGYRDYGHSRRHESYSRGYRNHPSSRETRDYAPPHRDYAYRDYGHSSWDEHSSRGYSYHDGYGEALGRDHSEHLSGSSYRDALQRYGTSHGAPPARGPRMSYGGSTCHAYSNTRDRYGRSWESYSSCGDFHYCDREHVCRKDQRNPPSLGRVLPDPREACGSSSYVASIVDGGESRSEKGDSSRY

SEQ ID NO: 769864 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 769865 - protein, 760 aa, Homo sapiens; identical to SEQ ID NO: 769864

SEQ ID NO: 769866 - protein, 760 aa, Homo sapiens; identical to SEQ ID NO: 769864

SEQ ID NO: 769867 - protein, 760 aa, Homo sapiens; identical to SEQ ID NO: 769864

SEQ ID NO: 769868 - protein, 760 aa, Homo sapiens; identical to SEQ ID NO: 769864

SEQ ID NO: 769869 - protein, 760 aa, Homo sapiens; identical to SEQ ID NO: 769864

SEQ ID NO: 769870 - protein, 760 aa, Homo sapiens; identical to SEQ ID NO: 769864

SEQ ID NO: 769871 - protein, 760 aa, Homo sapiens; identical to SEQ ID NO: 769864

SEQ ID NO: 769872 - protein, 760 aa, Homo sapiens; identical to SEQ ID NO: 769864

SEQ ID NO: 769873 - protein, 760 aa, Homo sapiens; identical to SEQ ID NO: 769864

SEQ ID NO: 769874 - protein, 760 aa, Homo sapiens; identical to SEQ ID NO: 769864

SEQ ID NO: 769875 - protein, 691 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVGDGENWRVIV

SEQ ID NO: 769876 - protein, 479 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKGRVQILILLNIGALHTVLDVILCFAHFACIPVVLMLDSSS

SEQ ID NO: 769877 - protein, 564 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEVSLFI

SEQ ID NO: 769878 - protein, 347 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFG

SEQ ID NO: 769879 - protein, 145 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIK

SEQ ID NO: 769880 - protein, 760 aa, Homo sapiens; identical to SEQ ID NO: 769864

SEQ ID NO: 769881 - protein, 760 aa, Homo sapiens; identical to SEQ ID NO: 769864

SEQ ID NO: 769882 - protein, 760 aa, Homo sapiens; identical to SEQ ID NO: 769864

SEQ ID NO: 769883 - protein, 744 aa, Homo sapiens
LVLACGSCLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 769884 - protein, 98 aa, Homo sapiens
RTRDQTDGHEETQWSVMRVEYHFLSPYVSPKESPFRHVFWGSGSHTLPALLENLKLRKQNNGAFNETLFRNQLALATWTIQGAANALSGDVWDIDNEF

SEQ ID NO: 769885 - protein, 760 aa, Homo sapiens; identical to SEQ ID NO: 769864

SEQ ID NO: 769886 - protein, 760 aa, Homo sapiens; identical to SEQ ID NO: 769864

SEQ ID NO: 769887 - protein, 760 aa, Homo sapiens; identical to SEQ ID NO: 769864

SEQ ID NO: 769888 - protein, 760 aa, Homo sapiens; identical to SEQ ID NO: 769864

SEQ ID NO: 769889 - protein, 760 aa, Homo sapiens; identical to SEQ ID NO: 769864

SEQ ID NO: 769890 - protein, 684 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMREGHR

SEQ ID NO: 769891 - protein, 652 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKVSTDSNYVFILLNVKYFEM

SEQ ID NO: 769892 - protein, 533 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGRRRGREFSSSSRRR

SEQ ID NO: 769893 - protein, 133 aa, Homo sapiens [sequence omitted]

SEQ ID NO: 769894 - protein, 1948 aa, Homo sapiens
SGRQRGAEWRLILLAGSEESNPPAPHSCPAPWLAQQGSSADSLSQPSPQGGGIGDTGKGKHWGGGAGESQIPREAMEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGCPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPHWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFRLLGMQLFGGRYDFEDTEVRRSNFDNFPQALISVFQVLTGEDWTSMMYNGIMASSGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVARCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGNPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYANSNHSNSHVFSSVHYEREFPEETETPATRGRALGQPCRSLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 769895 - protein, 906 aa, Homo sapiens
CCYYYQPCSSPHPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGNPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYANSNHSNSHVFSSVHYEREFPEETETPATRGRALGQPCRSLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 769896 - protein, 80 aa, Homo sapiens
DRGSLNGREEFVVLRRQNLLETSSPEFARYPLSKTAGGAFQGAGRGKLLAPRLLLCMAGNLVPGLPLTLFKSSTGSCMHC

SEQ ID NO: 769897 - protein, 109 aa, Homo sapiens
LDLARALVCHSLHHALLLPDTAPRGQVRLAQHFHLCSSHPAASPHRLHTCPAPEEVNLVMAYVKTVSRWFPPGIPALWEAKTGGSLEPTGLRPAWATWQNPVSIKNTKH

SEQ ID NO: 769898 - protein, 133 aa, Homo sapiens
MVVEVVVVMVVVVVIVVEMVVVMVEEVVVVMVAVAVVIVMEVTMVIVVVVVVVMVVEVVMVMVVVELVMVMVVVAVVIVIEVVMVMVAVAVVIVMEVAIVIVMMVVVVMVVEVVMVMVVVAVVIVMEVMMVMV

SEQ ID NO: 769899 - protein, 84 aa, Homo sapiens
KLSSVGGKRKTVESTEPWTVTQRMSTRSSLLCHSAQHDVNSTADRCSQEDRSPSTNSHQRKLFPRTQYVGPLTLHTAHDAEVQC

SEQ ID NO: 769900 - protein, 134 aa, Homo sapiens
WEVKGHSPVWRPFLLKLRLGTCGTCCSHEGRAAAWSAESSLQHSAVVTMSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 769901 - protein, 130 aa, Homo sapiens
KKKTKKKIVLLKLRLGTCGTCCSHEGRAAAWSAESSLQHSAVVTMSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 769902 - protein, 130 aa, Homo sapiens; identical to SEQ ID NO: 769901

SEQ ID NO: 769903 - protein, 130 aa, Homo sapiens; identical to SEQ ID NO: 769901

SEQ ID NO: 769904 - protein, 111 aa, Homo sapiens
KKKTKKKIVLLKLRLGTCGTCCSHEGRAAAWSAESSLQHSAVVTMSLPLNPKPFLNGLTGKPVMVKLKWGMEYKGYLVSVDGYMNMQIFIYILGILKQSKILLFQLSEDLK

SEQ ID NO: 769905 - protein, 134 aa, Homo sapiens; identical to SEQ ID NO: 769900

SEQ ID NO: 769906 - protein, 89 aa, Homo sapiens
ARYEAVVVPTQTFLNGLTGKPVMVKLKWGMEYKGYLVSVDGYMNMQLANTEEYIDGALSGHLGEVLIRCNNVLYIRGVEEEEEDGEMRE

SEQ ID NO: 769907 - protein, 130 aa, Homo sapiens; identical to SEQ ID NO: 769901

SEQ ID NO: 769908 - protein, 130 aa, Homo sapiens; identical to SEQ ID NO: 769901

SEQ ID NO: 769909 - protein, 171 aa, Homo sapiens
KKKTKKKIVLLKLRLGTCGTCCSHEGRAAAWSAESSLQHSAVVTMSLPLNPKPFLNGLTGKPVMVKLKWGMEYKGYLVSVDGYMNMQIFIYILGILKQNGVSLSSPRLECNGMISAHCNLCLPGSSDSPASASRVAGITARTSRTLTKRSGAVEILALFLILGGKHSVFYH

SEQ ID NO: 769910 - protein, 951 aa, Homo sapiens [sequence omitted]

SEQ ID NO: 769911 - protein, 951 aa, Homo sapiens [sequence omitted]

SEQ ID NO: 769912 - protein, 1005 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSVTASPGTLRAEPCQSSASVTAAAEPGSYQAASTTNRFDSRELYKRENLVKRQRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769913 - protein, 783 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKPGLLCRGGTGVLHGPGLVFRPFCP

SEQ ID NO: 769914 - protein, 951 aa, Homo sapiens [sequence omitted]

SEQ ID NO: 769915 - protein, 744 aa, Homo sapiens
MHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769916 - protein, 744 aa, Homo sapiens; identical to SEQ ID NO: 769915

SEQ ID NO: 769917 - protein, 744 aa, Homo sapiens; identical to SEQ ID NO: 769915

SEQ ID NO: 769918 - protein, 825 aa, Homo sapiens
MKREEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769919 - protein, 744 aa, Homo sapiens; identical to SEQ ID NO: 769915

SEQ ID NO: 769920 - protein, 825 aa, Homo sapiens; identical to SEQ ID NO: 769918

SEQ ID NO: 769921 - protein, 874 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769922 - protein, 979 aa, Homo sapiens
VLGYCRPRLSSGRRAAQKRTSLDAGDAVMYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769923 - protein, 750 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKLGAIYAGGGKKGLRKWANGRNRRVPGSHKSLWCANKGGEHLRGGPANKGRGRKELREKSPGVTRGLKD

SEQ ID NO: 769924 - protein, 744 aa, Homo sapiens; identical to SEQ ID NO: 769915

SEQ ID NO: 769925 - protein, 683 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQGLLIAFKLLERKEIHKYKIYLLSQKISRLPTRI

SEQ ID NO: 769926 - protein, 574 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKHVPPQKTGEPQWVDQEAQNCTEHGAAEPLNHRGNRSKGKDHITSGETAHVKQKYDRNDKGETLYTQSPNRTN

SEQ ID NO: 769927 - protein, 333 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKLVDPDHPHAVLSSNQ

SEQ ID NO: 769928 - protein, 328 aa, Homo sapiens
PELSRAAAARRSSSFCFAITSFPSATVLLDDASFFPPEPARAPTSAASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769929 - protein, 121 aa, Homo sapiens
MYGASGGRAKPERKSGAKEEAGPGGAGGGGSRVELLVFGYACKLFRDDERALAQEQGQHLIPWMGDHKILIDRSVPLPTRRSFPSLTRLISSDVDLTARTAESFLEPAGIWGTPPPLSPPP

SEQ ID NO: 769930 - protein, 688 aa, Homo sapiens
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQGLLIAFKLLERKEIHKYKIYLLSQKISQLGILKNTQRT

SEQ ID NO: 769931 - protein, 685 aa, Homo sapiens
MPAKNKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPPPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769932 - protein, 318 aa, Homo sapiens
QKRARYKLILSKFDLSKSKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 769933 - protein, 1012 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769934 - protein, 1012 aa, Homo sapiens; identical to SEQ ID NO: 769933

SEQ ID NO: 769935 - protein, 896 aa, Homo sapiens
MSRSLLAGLIVVFTRPKSLLLTRMNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769936 - protein, 1012 aa, Homo sapiens
MAVCFILHHIGGHIKLGRPTVPCITWIRYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769937 - protein, 923 aa, Homo sapiens
MSSQELLMLLLWDHTLKALVYSEAGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769938 - protein, 540 aa, Homo sapiens
MKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769939 - protein, 404 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSI

SEQ ID NO: 769940 - protein, 150 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQVRNVVLCFVL

SEQ ID NO: 769941 - protein, 108 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSVSNKSGKFCSMQGQPLGCLCFNL

SEQ ID NO: 769942 - protein, 1012 aa, Homo sapiens; identical to SEQ ID NO: 769933

SEQ ID NO: 769943 - protein, 765 aa, Homo sapiens
MTESILEMPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769944 - protein, 1049 aa, Homo sapiens
GGAYAGRVPGVTWCRARRVLLSVGPGAAQPEWGRELLKTIQFPFREANLGYLILLPEVAHAFKNRYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769945 - protein, 906 aa, Homo sapiens
NRNPDLCCTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 769946 - protein, 434 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEGSYLELN

SEQ ID NO: 769947 - protein, 452 aa, Homo sapiens
MTKHPPNRRGISFEVGAQLEARDRLKNCIQLTISTAPLHSRRQGKSHSSHFKRWTPIGSCMQSVLPGHQYLHFHARFSSTTSPACRAHSRGLQCKAGMASYPAHIPTHTHIARQESHMAFALVLAIVRYINHPRGAKQVHLLGNQPKGIGSPFHQLWWHKSVVMAMGQVHFPKADGSEHTKSNIQWFTQQTFCIPQQHRKQHNLGSETHIASGAPIKSKDEGKSKHTTGSLPNSNRSPWQLTDGKPANSSSTQAPERANTAQRGGKMLPQPQGTQSNSHQHHTRSKPASQEETGRSHNRARHLAFQRQPAHTVTTYRVPGTTGGEQRWHTHRHTGLRTHRQQTAQGTGQHGDTQTMFSQGKQWTTGKRTIQGEDKLQPKQVDVHDQTHDTHVNTMRTERSQPQQTPCKGDTHKKTTREREQPHMHQQHTKQRGASTPAPHNKQTPHKCTRGT

SEQ ID NO: 769948 - protein, 221 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILDPRSYPGLALTSLYPQNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 769949 - protein, 135 aa, Homo sapiens
MAAARPSLGRVLPGSSVLFLCDMQEKFRHNIAYFPQIVSVAARMLKNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 769950 - protein, 97 aa, Homo sapiens
RPSRLLGLGRGPAVRCWASSKARTPSSTELQPCLEGRPPSCHPDLSGSPFPPSLDPKSGAIHQECRPLVGGGRVLPSHWTAAPGNANETPGNWVGIG

SEQ ID NO: 769951 - protein, 184 aa, Homo sapiens
GPADCWALEEAQQSAAGPLPRPELPPPLNSNPALREDHPPVTRTSVEARSPHPWIPRVVRSTRSAAPLWGGAGCCLPIGQLLPEMQMRLLETGWELAEPRWRRGSAPGHFTGREGEGKKSLRLWDTDSQNKHICGKKKKNNNTQKKHRGPTKPGWAEKAGSERCTVGKTGPGHQHILAQGGTTR

SEQ ID NO: 769952 - protein, 205 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 769953 - protein, 215 aa, Homo sapiens
MASVSSWSRKMAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 769954 - protein, 119 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILVRC

SEQ ID NO: 769955 - protein, 72 aa, Homo sapiens
AVAPTLRAPSRSARPQPEQPGHDPGEPALPPHPALPGSRHPSLSWAHRGARQDLWPCNIPSILSSRSSPQWF

SEQ ID NO: 769956 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 769957 - protein, 144 aa, Homo sapiens
PSATWSHDLLPCPGLALEQGALIHSTSFTAGPSLPVALRYQPLTSLPPPSTLPPSRKSELVVEVKSDKLPEEMGLLQGSSGDKRAPGDQVGGGSCGQSLPHPQGPGAVGTNGSLYPSSLFVRDREQAPSCLLNTTHRWQGQASG

SEQ ID NO: 769958 - protein, 604 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEMERNTSI

SEQ ID NO: 769959 - protein, 601 aa, Homo sapiens
RHELPEEMGLLQGSSGDKRAPGDQGEKYIDLRHYPSQLPSLPGPFPAPCSLFQPKPPKGLERSLLLPSPAHPLERPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 769960 - protein, 349 aa, Homo sapiens
VVSSSAFLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 769961 - protein, 97 aa, Homo sapiens
ALRIPERVMRLNLSCEASGHPRPTISWNVNGTASEQDQDPQRVLSTLNVLVTPELLETGVECTASNDLGKNTSILFLELGEGCIPAGDGRGRPRHGQ

SEQ ID NO: 769962 - protein, 110 aa, Homo sapiens
GRSGKQEITLPPSREDMVNLTTLTPDSNTTTGLSTSTASPHTRANSTSTERKLPEPESRGVVIVAVIVCILVLAVLGAVLYFLYKKGKLPCRAAAVTRGLRETRERNTSI

SEQ ID NO: 769963 - protein, 646 aa, Homo sapiens; identical to SEQ ID NO: 769956

SEQ ID NO: 769964 - protein, 646 aa, Homo sapiens; identical to SEQ ID NO: 769956

SEQ ID NO: 769965 - protein, 646 aa, Homo sapiens; identical to SEQ ID NO: 769956

SEQ ID NO: 769966 - protein, 646 aa, Homo sapiens; identical to SEQ ID NO: 769956

SEQ ID NO: 769967 - protein, 645 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGAGPILPS

SEQ ID NO: 769968 - protein, 188 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRE

SEQ ID NO: 769969 - protein, 646 aa, Homo sapiens; identical to SEQ ID NO: 769956

SEQ ID NO: 769970 - protein, 646 aa, Homo sapiens; identical to SEQ ID NO: 769956

SEQ ID NO: 769971 - protein, 344 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVR

SEQ ID NO: 769972 - protein, 294 aa, Homo sapiens
TRKVCKKSRWYGPEFPGCQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 769973 - protein, 646 aa, Homo sapiens; identical to SEQ ID NO: 769956

SEQ ID NO: 769974 - protein, 646 aa, Homo sapiens; identical to SEQ ID NO: 769956

SEQ ID NO: 769975 - protein, 646 aa, Homo sapiens; identical to SEQ ID NO: 769956

SEQ ID NO: 769976 - protein, 646 aa, Homo sapiens; identical to SEQ ID NO: 769956

SEQ ID NO: 769977 - protein, 692 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQVGGGSCGQSLPHPQGPGAVGTNGSLYPSSLFVRDREQAPSCLLNTTHRWQGQASG

SEQ ID NO: 769978 - protein, 1165 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 769979 - protein, 906 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKKMPGTKELLGGGWLT

SEQ ID NO: 769980 - protein, 958 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKMLEGSMFVKSHHHSLISSTQGHKHCGRPQGPLHRKTRDLCSLVYLLTLPPLLSYDPAKSPSVRNTQE

SEQ ID NO: 769981 - protein, 178 aa, Homo sapiens
EFCTGGGGALRGRGGLGDPRGTSRSGLGRLPGPWQEAGSSRGPSSGDMAGVKALVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 769982 - protein, 134 aa, Homo sapiens
SSLDMAGVTLVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 769983 - protein, 140 aa, Homo sapiens
SSLDMAGVTLVALSFSGAIGLTFLMLGCALEDYGLGPTDSVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 769984 - protein, 115 aa, Homo sapiens
ALQDSARALVALSFSGAIGLTFLMLGCALEDYGVYWPLFVLIFHAISPIPHFIAYFFTTGIVVSAFGFPVILARVAVIKWGACGLVLAGNAVIFLTIQGFFLIFGRGDDFSWEQW

SEQ ID NO: 769985 - protein, 178 aa, Homo sapiens; identical to SEQ ID NO: 769981

SEQ ID NO: 769986 - protein, 178 aa, Homo sapiens; identical to SEQ ID NO: 769981

SEQ ID NO: 769987 - protein, 896 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 769988 - protein, 896 aa, Homo sapiens; identical to SEQ ID NO: 769987

SEQ ID NO: 769989 - protein, 386 aa, Homo sapiens [sequence omitted]

SEQ ID NO: 769990 - protein, 190 aa, Homo sapiens
EFCTGGGGALRGRGGLGDPRGTSRSGLGRLPGPWQEAGSSRGPSSGDMAGVKALVALSFSGAIGLTFLMLGCALEDYGVYWPLFVLIFHAISPIPHFIAKRVTYDSDATSSACRELAYFFTTGIVVSAFGFPVILARVAVVSFIFYCFAQPLLSLLQRPVSGTSISCSLLRLYTQGRVFLVSLFLYFRPA

SEQ ID NO: 769991 - protein, 958 aa, Homo sapiens; identical to SEQ ID NO: 769980

SEQ ID NO: 769992 - protein, 204 aa, Homo sapiens
GTRLHTSDWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVCSPGISKNGQTREHALLAYTLCVKQSNCRCNKMVPLTTYS

SEQ ID NO: 769993 - protein, 110 aa, Homo sapiens
MLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 769994 - protein, 120 aa, Homo sapiens
EFCTGGGGALRGRGGLGDPRGTSRSGLGRLPGPWQEAGSSRGPSSGDMAGVKALVALSFSGAIGLTFLMLGCALEDYGSNGEPAALCWQAMQSFSLQFKGFSLYLEEEMILAGSSGSTLF

SEQ ID NO: 769995 - protein, 178 aa, Homo sapiens; identical to SEQ ID NO: 769981

SEQ ID NO: 769996 - protein, 178 aa, Homo sapiens; identical to SEQ ID NO: 769981

SEQ ID NO: 769997 - protein, 896 aa, Homo sapiens; identical to SEQ ID NO: 769987

SEQ ID NO: 769998 - protein, 896 aa, Homo sapiens; identical to SEQ ID NO: 769987

SEQ ID NO: 769999 - protein, 152 aa, Homo sapiens
SSLDMAGVTLVALSFSGAIGLTFLMLGCALEDYGLGPTDSVYWPLFVLIFHAISPIPHFIAKRVTYDSDATSSACRELAYFFTTGIVVSAFGFPVILARVAVVSFIFYCFAQPLLSLLQRPVSGTSISCSLLRLYTQGRVFLVSLFLYFRPA

SEQ ID NO: 770000 - protein, 34 aa, Homo sapiens
MATVTALRRKVPPAVTGITFLSGGQSEEEASINL

SEQ ID NO: 770001 - protein, 295 aa, Homo sapiens
RWCQHQPPCRSQRTFSPPLSYSLSVSKISVNYLLDCIDAIEKAACSLKVMVLKAEHTRSPSATLPSNVPSCRSLSSSEDGPSGPSSLADGGLAHNLQDSVRHRILYLSEQLRVEKASRDGNTVSYLKLVSKADRHQVPHIQQAFEKVNQRASATIAQIEHRLHQCHQQLQELEEGCRPEGLLLMAESDPANCEPPSEKALLSEPPEPGGEDGPVNLPHASRPFILESRFQSLQQGTCLETEDVAQQQNLLLQKVKAELEEAKRFHISLQESYHSLKERSLTDLQLLLESLQEEKC

SEQ ID NO: 770002 - protein, 126 aa, Homo sapiens
MKSVAQLVYFFGLLLLNFVSPKSEYESFCVLSLLLFFREVKVVGVQPIFVYFFCSSYIYYYWWFLSGNFSFTLTLALPPSAFFSWLQLSTIICGFPEGEPWWSGGGGSPHSKSGVVGVPDRVLIQE

SEQ ID NO: 770003 - protein, 135 aa, Homo sapiens
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 770004 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 770005 - protein, 102 aa, Homo sapiens
SGWQAPGGIPADSLTAFEVRRPPGGNWVAAPSRLRWLSPPTLQPGLDGGTELGFFALGGEWWWLKGRWNFPRKPTPRAPPSSSVTLRSILLAELPRLLMGKT

SEQ ID NO: 770006 - protein, 135 aa, Homo sapiens; identical to SEQ ID NO: 770003

SEQ ID NO: 770007 - protein, 162 aa, Homo sapiens; identical to SEQ ID NO: 770004

SEQ ID NO: 770008 - protein, 162 aa, Homo sapiens; identical to SEQ ID NO: 770004

SEQ ID NO: 770009 - protein, 106 aa, Homo sapiens
SGWQAPGGIPADSLTAFEVRRPPGGNWVAAPSRLRWLSPPTLQPGLDGESIPIYGHVALWSNVPSCSMLLTSHGAQKSMLADSQPIQDRFQLVAPLCPELMGSWSH

SEQ ID NO: 770010 - protein, 162 aa, Homo sapiens; identical to SEQ ID NO: 770004

SEQ ID NO: 770011 - protein, 136 aa, Homo sapiens [sequence omitted]

SEQ ID NO: 770012 - protein, 34 aa, Homo sapiens
MLGTALPRQDLSVDSFQRSCLARRWPRLQPSQAL

SEQ ID NO: 770013 - protein, 155 aa, Homo sapiens
EPALLSPWAVNGARRCEAGGGACQGGSGGAGGSGGLLRHAGLQVPSPSRWEEAEAWQELERCAGRPEVLADPAHPPQLLAQVLSFSLPGASIVSCLLGMRGQPSPHPPGTRAGQRAPARGPGSTRASLSKPPGKQREPAPASASPERGFHSAAVS

SEQ ID NO: 770014 - protein, 110 aa, Homo sapiens [sequence omitted]

SEQ ID NO: 770015 - protein, 87 aa, Homo sapiens
RTRGSTHASARLREDDTRGGLALCSVFGFCHYRLPQLYCENSAAPLMCTWMMLLLHLHLLHVTHALPLPSAHSKFKERRKANLYPCP

SEQ ID NO: 770016 - protein, 384 aa, Homo sapiens
SKAKESQQYYHSLAVRQSLAVHFNIQQDCGHFLAEVPNRLLPWEDPDDPEKDEDDMEETEEDAKGETDGKNPKPCSEAASSQKENQGVMSKKQRSHVVVITREVPCLTVADFVRDSLAQHGKSPDLYERQVCLLLLQLCSGLEHLKPYHVTHCDLRLENLLLVHYQPGGTAQGFGPAEPSPTSSYPTRLIVSNFSQAKQKSHLVDPEILRDQSRLAPEIITATQYKKCDEFQTGILIYEMLHLPNPFDENPELKEREYTRADLPRIPFRSPYSRGLQQLASCLLNPNPSERILISDAKGILQCLLWGPREDLFQTFTACPSLVQRNTLLQNWLDIKRTLLMIKFAEKSLDREGGISLEDWLCAQYLAFATTDSLSCIVKILQHR

SEQ ID NO: 770017 - protein, 85 aa, Homo sapiens
VNTDLETWALACSAPWRIWAQMVWAPTCCLLRVPGWAHAGHHPSLGSVYHILLAFLGDHVDWLSRASQCQECSRFHPLFLLERFS

SEQ ID NO: 770018 - protein, 183 aa, Homo sapiens
MLARMARSPDLVICQPRAPKVLRLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQ

SEQ ID NO: 770019 - protein, 114 aa, Homo sapiens
MTLGKVLTFLTSAFPDLENRVKLPCLHASKALAHTQGCSPALPPRSSMTGKTEGERNTCKFGVSYDRGARTFSRRQAMASRAQSTVRVKEDDSTHNSCSVNIFSLLQPYSFHIA

SEQ ID NO: 770020 - protein, 113 aa, Homo sapiens
MATRTLNLSFFPRSHWPPGTCSLATAIMKDLTGLSTCAQATQVEVEGMGFKPRPSLALNIYLKQPPYQEGGCPAWSEECMEQSQPTQVGCVTWPRNPPMLLRATAPWGHVSPN

SEQ ID NO: 770021 - protein, 134 aa, Homo sapiens
PRSAVLLIHSSAEALAVCSSNTDAVSFAGDWKWRSEFHSGNVWPASRRGRASEGLVRCRAQHSEHTSCAPLFVGVSVRDPDAEAWLVGWCDMGFLRARVDHVSAYRAVALHVDRNACSDMLCGCVMPQIIPLTA

SEQ ID NO: 770022 - protein, 34 aa, Homo sapiens
SSSSSSSGSQLKCHLLGKASLIPPASNVTCTPSH

SEQ ID NO: 770023 - protein, 316 aa, Homo sapiens [sequence omitted]

SEQ ID NO: 770024 - protein, 284 aa, Homo sapiens
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGYQASGKSTLGSVGNWQGFYFGGKMAETNADSILVEIFSPFTIKIIFWCLMPKYLEKFPQRRLSDLRN

SEQ ID NO: 770025 - protein, 154 aa, Homo sapiens
ATMERPLEKPSCSLGIKTSNASLQDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESM

SEQ ID NO: 770026 - protein, 216 aa, Homo sapiens
TFLSSTVKRAGTCQARPNRTSGAMRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERNLPSHPKEPESSQDPLEEEGSLLPALGVPIQTDKMEH

SEQ ID NO: 770027 - protein, 224 aa, Homo sapiens
TFLSSTVKRAGTCQARPNRTSGAMRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERKSESAHPVGSPGESGTSGWRGGDTPSPLCLLLLLLLLILRLLRIL

SEQ ID NO: 770028 - protein, 224 aa, Homo sapiens; identical to SEQ ID NO: 770027

SEQ ID NO: 770029 - protein, 179 aa, Homo sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERSDSCRSLSPHHRLKKSSRQPWTL

SEQ ID NO: 770030 - protein, 110 aa, Homo sapiens
MPAAWILWAHSHSELHTVMETPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 770031 - protein, 107 aa, Homo sapiens
MYIKEHKGTPKLHTVMETPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 770032 - protein, 121 aa, Homo sapiens
SPLSALDSLFALSPTLIMGHSSISELHTVMETPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 770033 - protein, 30 aa, Homo sapiens
LTPPLRPAAKSLSGVFNSANPGAAQPPGKK

SEQ ID NO: 770034 - protein, 456 aa, Homo sapiens
VRKQDKVGILGERAGTMRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 770035 - protein, 262 aa, Homo sapiens
MHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 770036 - protein, 440 aa, Homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 770037 - protein, 159 aa, Homo sapiens
MEAVPWLEVTSTRTAQGCPRLQNQLKINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 770038 - protein, 88 aa, Homo sapiens
MGQEAVGGQGPLGLAPTLTPTLSFFSHFPLLPRKPSFPFQWAWESIATDVRAVLQPSSPTPGHQALPMPSSFSQRQSRRKSTANLPEA

SEQ ID NO: 770039 - protein, 121 aa, Homo sapiens
GRGAANACLPGKSSHQERGVLVGCPSPALSARDALLRSSCELRGLRLRKAKLFQEAAAAPLALSGCGERAGGRGALQDSVVSEKLDFPGSEGQFGIVIEQNVGGIKCSEVEITLKTGPLAL

SEQ ID NO: 770040 - protein, 306 aa, Homo sapiens
MHTWLGVRVSAAPLGQGRWPHTHSFPSKLPMLTEGTSGVQARNEVRGILAGTNLLLLNPTGLCGLASGDRGVWFSAGGRPPWPVSGVLGSRVCGPLYSTSPAGPGRAASLPRKGAQLELEEMLVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIKFEKDLRRIWLKAGLKEAPEGWQTPKIYLRGNESGAAFPPVAAVIENNLRIEEEKWDIMGEEVRKRRMDVVRNWDKREKG

SEQ ID NO: 770041 - protein, 247 aa, Homo sapiens
MLLGRLTSQLLRAVPWAGGRPPWPVSGVLGSRVCGPLYSTSPAGPGRAASLPRKGAQLELEEMLVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIKFEKDLRRIWLKAGLKEAPEGWQTPKIYLRGNESGAAFPPVAAVIENNLRIEEEKWDIMGEEVRKRRMDVVRNWDKREKG

SEQ ID NO: 770042 - protein, 247 aa, Homo sapiens; identical to SEQ ID NO: 770041

SEQ ID NO: 770043 - protein, 638 aa, Homo sapiens
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 770044 - protein, 158 aa, Homo sapiens
MHPNTGAPRFIKRVLRELQRDLDAHTIIMGDFNTPLSTLDRSMRQKVNYGYPGIELSSARNPRAWVPCRGSEIQPPPVNRNLKPDRKAKPTPLDLRNNTVIDELPFKSPITKSWSRANHTFNSSSSQYCRPISTQSITSTDSGDSEENYVPMVSPSGF

SEQ ID NO: 770045 - protein, 676 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 770046 - protein, 676 aa, Homo sapiens; identical to SEQ ID NO: 770045

SEQ ID NO: 770047 - protein, 676 aa, Homo sapiens; identical to SEQ ID NO: 770045

SEQ ID NO: 770048 - protein, 320 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPKFFLPHLGLHKMQGKPDWSQER

SEQ ID NO: 770049 - protein, 199 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQLAPELTTRPCINRSPLIT

SEQ ID NO: 770050 - protein, 676 aa, Homo sapiens; identical to SEQ ID NO: 770045

SEQ ID NO: 770051 - protein, 171 aa, Homo sapiens
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAE

SEQ ID NO: 770052 - protein, 75 aa, Homo sapiens
YNKNKAEVKKLLVASENKDMTYQNPWDTAKAVLRGKFIALNAHIKKLERSQFNNLISQLKGLENQEKTNPKTNRR

SEQ ID NO: 770053 - protein, 73 aa, Homo sapiens
SDCCASNQRDSLWVGPSEPGAAYNLVVRRFLSRSEKRSIRVGVTRFSRDGRRYLEKSGKSEEDTSKNRGRFSS

SEQ ID NO: 770054 - protein, 158 aa, Homo sapiens
RNQPVQKRNSEFLANVSTITSDYSTTSSAAYLTSLDSSRLSPEVQSAAESKGDEADDERSELISKGRPVETDSESEFPVFPTALTSERLFRGKLQEVTKSSRRNSEGSELSCTEGSLTSSLDSRRQLFSSHKLIECDTLSRKKSARFKSDSGSLGDAK

SEQ ID NO: 770055 - protein, 264 aa, Homo sapiens
EILTKLCKDNKLDGPYFHPGKIQIGNQVFSGKTIFTEEDTDETVESYEHLALKVLHSWEDIPEVGCRLVPEHIETRPLYHKDKPRMEQGRLQMWVDMFPKDMPQPGPPVDISPRRPKGYELRVTIWNTEDVILEDENIFTGQKSSDIYVKGWLKGLEDDKQETDVHYNSLTGEGNFNWRFLFPFQYLPAEKQMVITKRENIFSLEKMECKTPAVLVLQVWDFERLSSDDFLGTLEMNLNSFPRAAKSAKACDLAKFENASEETK

SEQ ID NO: 770056 - protein, 243 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEILGLTHTYSVAQGLRLQWKRRSEKDAVVTMVVLSSNLGNPLVVHHQV

SEQ ID NO: 770057 - protein, 237 aa, Homo sapiens
AAAAVRRSNGQPRRSRSAGPLQPAATAPLWERPQQEPKGSYGGAKAAGAASASPSRALPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEILGLTHTYSVAQGLRLQWKRTRVKRRRGDDGGSFLEPGKSIGCPSSS

SEQ ID NO: 770058 - protein, 240 aa, Homo sapiens
IYRILCPIPEGNRREKIYEEQNRGIYMFRINNEHVIDATLTGGPARYINHSCAPNCVAEVVTFDKEDKIIIISSRRIPKGEELTYDYQFDFEDDQHKIPCHCGAWNCRKWMNKEALRLPGRGVPLPTTSSLKGMRGKRGSSQSQDPGLGLPADPEPLEQEAGAEGPRPSPPWAPGTILFPTTGPQAGISAPSSRRGQTEAAIGHLRFEGDMGRELPRSIWEAAGWGKRMCGRASQPCCSH

SEQ ID NO: 770059 - protein, 220 aa, Homo sapiens
DLGLPGPSLQPSLASSACGTCSRLRLKMPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 770060 - protein, 132 aa, Homo sapiens
MVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKG

SEQ ID NO: 770061 - protein, 156 aa, Homo sapiens
MVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 770062 - protein, 125 aa, Homo sapiens
QENRNACPHLDPWAQNRGWSPREGPCPSLPSACLHTSVSVGSYSFSGDWSPSQGPCPFLPSTSLPPSISIESHFVAQAGVQWCDLGSLQPPLPGLKQSFRLSVPSSWDHRYEPPCLADFFIFSRD

SEQ ID NO: 770063 - protein, 1134 aa, Homo sapiens
MSRSVLQPSQQKLAEKLTILNDRGVGMLTRLYNIKKQGQVWKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 770064 - protein, 731 aa, Homo sapiens
MLWNLRHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 770065 - protein, 998 aa, Homo sapiens
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDILAKPKGKKTKKGGFWGAFKPPFSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGEFLALASSSLLKIGQETDKTTTRNRESVYLLLDMIVQESPFLTMDLLESCFPYVLLRNAYHAVYKQSVTSSA

SEQ ID NO: 770066 - protein, 1128 aa, Homo sapiens
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 770067 - protein, 983 aa, Homo sapiens
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGEFLALASSSLLKIGQETDKTTTRNRESVYLLLDMIVQESPFLTMDLLESCFPYVLLRNAYHAVYKQSVTSSA

SEQ ID NO: 770068 - protein, 388 aa, Homo sapiens
RKKKGKRKYKIEKKRNLGTTYCKTSARPQLQKAQRQKVNSFMTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 770069 - protein, 291 aa, Homo sapiens
LVIVCKFKEKKMMKEKEKTIAIVKVIDTSKLKLLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 770070 - protein, 347 aa, Homo sapiens
MTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 770071 - protein, 104 aa, Homo sapiens
ARPQLQKAQRQKVNSFMTLDHQIINPTLKWSQPAVPSGGPLVQHAHTTLDSDAGLTENPLTKLLAIGKEDDNAQWHVCLMAGYKNISSVFEKTSIKVIEVNILQ

SEQ ID NO: 770072 - protein, 347 aa, Homo sapiens; identical to SEQ ID NO: 770070

SEQ ID NO: 770073 - protein, 418 aa, Homo sapiens
ERRLQISQEISAHRTEFHMQFSYKPVLHRLVPARPQIYSSQLPSFTRVPAHLESSARPQLQKAQRQKVNSFMTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 770074 - protein, 318 aa, Homo sapiens
MTLDHQIINPTLKWSQPAVPSGGPLVQHAHTTLDSDAGLTENPLTKLLAIGKEDDNAQWHLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 770075 - protein, 823 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 770076 - protein, 509 aa, Homo sapiens
MLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 770077 - protein, 509 aa, Homo sapiens; identical to SEQ ID NO: 770076

SEQ ID NO: 770078 - protein, 132 aa, Homo sapiens
MRSQERRGPCASCCPTQSSRASGRVCSPLAAGPVHLVDHSISAQCVSSQHSVQYVAGTHDTLVEQRPGCPHPYRSSFLSARYSSRGNSIFRASPMTKSQTSELLPRAVWSVFVLISRHSKNSHATPPKAGNP

SEQ ID NO: 770079 - protein, 96 aa, Homo sapiens
MPKEALKLPGTLPNPGRAVIKNGAQKAPGTFTDTRHLHQPCSRIVLLQTTSSEGSPAGWEIAPPGPHCGYTRRYTSESATHTPEISLYCAYTTHRA

SEQ ID NO: 770080 - protein, 394 aa, Homo sapiens
RGGAAAGRGRMTRRGRRRSSHFLGPPAGAAGCTQRRSRELAAAAMSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 770081 - protein, 394 aa, Homo sapiens; identical to SEQ ID NO: 770080

SEQ ID NO: 770082 - protein, 524 aa, Homo sapiens
RGGAAAGRGRMTRRGRRRSSHFLGPPAGAAGCTQRRSRELAAAAMSHQTGIQGNSARRDSQGRGFRESRESREGCRTGRAGVGPGAPEVGLAGRAGPRRLSALLLPGRCRPASSSSPVPAAVTLQIDPKFGGAKEIGFRGGLVEGGVPSTVPDSRPTFPLLVTYGRAGTVEATGASVRCREPASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 770083 - protein, 252 aa, Homo sapiens
MLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 770084 - protein, 394 aa, Homo sapiens; identical to SEQ ID NO: 770080

SEQ ID NO: 770085 - protein, 394 aa, Homo sapiens; identical to SEQ ID NO: 770080

SEQ ID NO: 770086 - protein, 108 aa, Homo sapiens
YEFDSLFYFLQSEPRGSYWGMHSHMFYDVFINQYHLCCRISIHFFKSKISIGLSVATLRMRLSTSYHLSSIKILNMCIECFLIFLLFQYMHTMFLVKKSLKSGTSAVV

SEQ ID NO: 770087 - protein, 265 aa, Homo sapiens
MQLYLTSIISWFEIGQPAASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIGI

SEQ ID NO: 770088 - protein, 163 aa, Homo sapiens
RGGAAAGRGRMTRRGRRRSSHFLGPPAGAAGCTQRRSRELAAAAMSHQTGIQGNSARRDSQGRGFRESRESREGCRTGRAGVGPGAPEVGLAGRAGPRRLSALLLPGRCRPASSSSPVPAAVTLQIDPKFGGAKEIGFRGGLVEGGVPSTVPDSRPTFPLLVT

SEQ ID NO: 770089 - protein, 252 aa, Homo sapiens; identical to SEQ ID NO: 770083

SEQ ID NO: 770090 - protein, 401 aa, Homo sapiens
RGGAAAGRGRMTRRGRRRSSHFLGPPAGAAGCTQRRSRELAAAAMSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINESPEDHIGVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 770091 - protein, 163 aa, Homo sapiens; identical to SEQ ID NO: 770088

SEQ ID NO: 770092 - protein, 104 aa, Homo sapiens
MPWGGRQKVANKWVCISDNHLGAAILKLDIITQVRIGLLVHGKRPPHSLWYCIGMSLQAKCLPILQTEARGDRADWWPNVKESNFLIRYIPLSDLSVFSHQITN

SEQ ID NO: 770093 - protein, 305 aa, Homo sapiens
MPCWNPGLSRSRSVGRHDDSSPVSPPPGPSRRAVELARRLGAPCAAPLLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFSVTLTTVGFGDYVAGADPRQDSPGYQPLVWFWILLGLAYFASVLTTNRELAASRCRAALGPEMGRAHGFRAAKLELGTCDSAALTSEPGPARPGRRTKDQHWLPS

SEQ ID NO: 770094 - protein, 54 aa, Homo sapiens
SCEGGQEGEGAGAVHLVGSLGLCPPSPRTPSAKAHTHPSQLMASGTLRALMNPG

SEQ ID NO: 770095 - protein, 108 aa, Homo sapiens
MEAVFDMELTLLWEAPTVYLDHWLLGGCGGKNQTPVLPCALYLPLSLALITLLYIIILHTLTHDFYTHGSICYKHTDKKGFLFSSDFLIYINIWVSYKLMGLSAIITN

SEQ ID NO: 770096 - protein, 130 aa, Homo sapiens
MAPPGNPKLQQLAPDLTHRFSKHMYDGINQCMKPSTATFLPLQTQRTEIPALHLSGQKPRHHLGIPPTHSPIPISIPVASLDLPVSPHPHCPCLGPGHHHLSPGHCGLLPSSLPASHPGLLCPSSTLSLK

SEQ ID NO: 770097 - protein, 92 aa, Homo sapiens
DRRQFVSTNFYSTEADSENHFITMARHERSTGELQSFGKDLCNNWKHSVPKWHGAEGRKKTKNEDKRSLFPQEDCNLVVELENKGKQWPCMS

SEQ ID NO: 770098 - protein, 249 aa, Homo sapiens
LSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYT

SEQ ID NO: 770099 - protein, 163 aa, Homo sapiens [sequence omitted]

SEQ ID NO: 770100 - protein, 104 aa, Homo sapiens
EFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNKMSGF

SEQ ID NO: 770101 - protein, 68 aa, Homo sapiens
MTLQEAHVAGAVWDSGGERKCTAQGMWRQAQRQAWGPEGAAGEQGAGPGVPPCRSEACPAQDSEVQQE

SEQ ID NO: 770102 - protein, 731 aa, Homo sapiens
SQRRRVPRGREASPPAQPGTSLPAQPGRSPGGKATLLALYCRITRGLATGVAGKWKEEQMSQSRRVNPDDRELGGDPQIQAPRDQLGSLADGHQCHLLTSRMETTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 770103 - protein, 159 aa, Homo sapiens
MTFPDLGTVGSQAKTWQPRPKWEIPTKHIHQTSSLFLSPLPLSYAPISPENAPNFTKCLWSPRGSAPGEKGEAEEVELWEFTALISGAAPFFSVVSGWLLRLLRSGLERPHDQSFHMSPAPIAICLEVSLWSPPQPRGIFSFVRHYSHIGFIETFLGAP

SEQ ID NO: 770104 - protein, 217 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 770105 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 770106 - protein, 262 aa, Homo sapiens
LGHEGPRLVLLSLPRPGDRRHEGPPAEMTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 770107 - protein, 102 aa, Homo sapiens
VGSEFGSTGSNVGSEFGSKGLILRSLKQRSETDIYASHFTGEDTEAHRGESPARGCIAWTQRKLARGRSLPWAPLIPSPEWRQRQNPAPAPFTQLCTKPLSP

SEQ ID NO: 770108 - protein, 244 aa, Homo sapiens
MTVLAPAWSPTTYLLLLLLLSSGLSGTQDCSFQHSPISSDFAVKIRELPGLILFSPQSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 770109 - protein, 153 aa, Homo sapiens
MPSASTPQPLGGRWDRAPRSRVRRLSRRLRPRGSPPGAWGAAWAWRAAGPKLCPAGRRLRPSENSSTTWAGGPAVQGDPAHPPKLLAWVLSPSLPGAGGASRRLPVRGPPSPRAPRGAMVPARATRPTPPRKQREPAPASAGPERGSHCAAAG

SEQ ID NO: 770110 - protein, 532 aa, Homo sapiens
MESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDECEDDYNYYYTRS

SEQ ID NO: 770111 - protein, 139 aa, Homo sapiens
SLYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLSK

SEQ ID NO: 770112 - protein, 384 aa, Homo sapiens
SLYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 770113 - protein, 252 aa, Homo sapiens
TRGSTHASKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 770114 - protein, 384 aa, Homo sapiens; identical to SEQ ID NO: 770112

SEQ ID NO: 770115 - protein, 384 aa, Homo sapiens; identical to SEQ ID NO: 770112

SEQ ID NO: 770116 - protein, 369 aa, Homo sapiens
SLYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAICTGEYAELYSTCRYRARM

SEQ ID NO: 770117 - protein, 362 aa, Homo sapiens
SLYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 770118 - protein, 384 aa, Homo sapiens; identical to SEQ ID NO: 770112

SEQ ID NO: 770119 - protein, 384 aa, Homo sapiens; identical to SEQ ID NO: 770112

SEQ ID NO: 770120 - protein, 384 aa, Homo sapiens; identical to SEQ ID NO: 770112

SEQ ID NO: 770121 - protein, 129 aa, Homo sapiens
SLYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGVSI

SEQ ID NO: 770122 - protein, 402 aa, Homo sapiens
MSSRLGLERTVTVSQLKVATRALPTGETMPMISAASDPGPSRPSRPTPDQPRARLGRRRGFPSLTRARPMPGGAWGPPPPPVAGEPQARATRSSGPGSGLDGYVEAGRPTDRRPKAAVRWAGGDAQPQPHRAAWSSPPCWPRLAAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 770123 - protein, 441 aa, Homo sapiens
MSSRLGLERTVTVSQLKVATRALPTGETMPMISAASDPGPSRPSRPTPDQPRARLGRRRGFPSLTRARPMPGGAWGPPPPPVAGEPQARATRSSGPGSGLMATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 770124 - protein, 326 aa, Homo sapiens
MSSRLGLERTVTVSQLKVATRALPTGETMPMISAASDPGPSRPSRPTPDQPRARLGRRRGFPSLTRARPMPGGAWGPPPPPVAGEPQARATRSSGPGSGLMATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGSEPLPPTQWRSRCPFLRSSGLLPADSEGPGGPGALEWIDSQFTEDSSIFWNYV

SEQ ID NO: 770125 - protein, 414 aa, Homo sapiens
MSSRLGLERTVTVSQLKVATRALPTGETMPMISAASDPGPSRPSRPTPDQPRARLGRRRGFPSLTRARPMPGGAWGPPPPPVAGEPQARATRSSGPGSGLMATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKVRRATSLRCSPASSNSTLFLCHPQPLLQFAWKTPSSTNG

SEQ ID NO: 770126 - protein, 536 aa, Homo sapiens
AAARDLELKRKSQNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 770127 - protein, 536 aa, Homo sapiens; identical to SEQ ID NO: 770126

SEQ ID NO: 770128 - protein, 512 aa, Homo sapiens
AAARDLELKRKSQNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 770129 - protein, 385 aa, Homo sapiens
MPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 770130 - protein, 181 aa, Homo sapiens
AAARDLELKRKSQNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQVSV

SEQ ID NO: 770131 - protein, 154 aa, Homo sapiens
AAARDLELKRKSQNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQ

SEQ ID NO: 770132 - protein, 536 aa, Homo sapiens; identical to SEQ ID NO: 770126

SEQ ID NO: 770133 - protein, 466 aa, Homo sapiens
MLSEEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 770134 - protein, 210 aa, Homo sapiens
AAARDLELKRKSQNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQKHNISWIS

SEQ ID NO: 770135 - protein, 72 aa, Homo sapiens
SERTPGEDRRKGSKSPKQQPDRAPKGALGRPRAHRLSGEKGIRLHETPARPGGDKPKWSSNLPLWEAGSISW

SEQ ID NO: 770136 - protein, 736 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 770137 - protein, 736 aa, Homo sapiens; identical to SEQ ID NO: 770136

SEQ ID NO: 770138 - protein, 426 aa, Homo sapiens
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 770139 - protein, 459 aa, Homo sapiens
WRTAGTGFSGELAPLLQPLSPAPRRRRGFPSQREWRWRKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 770140 - protein, 725 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVPLLGSGKRR

SEQ ID NO: 770141 - protein, 426 aa, Homo sapiens; identical to SEQ ID NO: 770138

SEQ ID NO: 770142 - protein, 731 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTAASSTTFPKANKRKNQNIGYKLGHRRAPFEKRKRLSDYALIFGMFGIVVMVIETELSWGLYSKDSMFSLALKCLISLSTIILLGLIIAYHTREAQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 770143 - protein, 870 aa, Homo sapiens
MLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 770144 - protein, 91 aa, Homo sapiens
WRYTEPRGSREGGGRGHPAERESGEPCTEEHCPDCLNTRGEKRHLQVNVTNPVQCSLHGKKCTVSVETRLNQPQPDFTKNRSGFILSVPGN

SEQ ID NO: 770145 - protein, 870 aa, Homo sapiens; identical to SEQ ID NO: 770143

SEQ ID NO: 770146 - protein, 870 aa, Homo sapiens; identical to SEQ ID NO: 770143

SEQ ID NO: 770147 - protein, 461 aa, Homo sapiens
MLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKYRWGFTMLTRLVLNS

SEQ ID NO: 770148 - protein, 125 aa, Homo sapiens
GSQGPCHGAEAVVGGPASATLALPRPLWGPSGILLALVEEAGCAGANGGRELPGRCPVLMLPANCPSGVFGSCSEKRHLQVNVTNPVQCSLHGKKCTVSVETRLNQPQPDFTKNRSGFILSVPGN

SEQ ID NO: 770149 - protein, 870 aa, Homo sapiens; identical to SEQ ID NO: 770143

SEQ ID NO: 770150 - protein, 825 aa, Homo sapiens
MLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKRNHLLIL

SEQ ID NO: 770151 - protein, 261 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770152 - protein, 114 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRD

SEQ ID NO: 770153 - protein, 120 aa, Homo sapiens
LGPLLCHSLCLQQASLLDCPLPCTLPTCMHTHRHSCTRSHMHPCMHTYMHTCTLTSFAWPIPTLLSALSLKATASSDNSLLTFYTRAPLCPLEAPYLFVLFLQVLLTNSNYLMSVFPTRL

SEQ ID NO: 770154 - protein, 102 aa, Homo sapiens
MNRPSARNALGNVFVSELLETLAQLREDRQVRVLLFRSGVKGVFCAGADLKEREQMSEAEVGVFVQRLRGLMNDIGFKPGHSKAVKFPQACFQVLTIAVTFA

SEQ ID NO: 770155 - protein, 102 aa, Homo sapiens; identical to SEQ ID NO: 770154

SEQ ID NO: 770156 - protein, 135 aa, Homo sapiens
MGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770157 - protein, 102 aa, Homo sapiens; identical to SEQ ID NO: 770154

SEQ ID NO: 770158 - protein, 102 aa, Homo sapiens; identical to SEQ ID NO: 770154

SEQ ID NO: 770159 - protein, 120 aa, Homo sapiens; identical to SEQ ID NO: 770153

SEQ ID NO: 770160 - protein, 173 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAGTGPGLGAGGGARESGVSETG

SEQ ID NO: 770161 - protein, 246 aa, Homo sapiens
MNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770162 - protein, 292 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770163 - protein, 196 aa, Homo sapiens
MNRPSARNALGNVFVSELLETLAQLREDRQVRVLLFRSGVKGVFCAGADLKEREQMSEAEVGVFVQRLRGLMNDIGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770164 - protein, 215 aa, Homo sapiens
MNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 770165 - protein, 114 aa, Homo sapiens; identical to SEQ ID NO: 770152

SEQ ID NO: 770166 - protein, 119 aa, Homo sapiens
MGLIETTRGLLPGAGGTQRLPRCLGVALAKELIFTGRRLSGTEAHVLGLVNHAVAQNEEGDAAYQRARALAQEILPQAPIAVRLGKVAIDRGTENIPTRDRLEGMAAFREKRTPKFVGK

SEQ ID NO: 770167 - protein, 324 aa, Homo sapiens
MNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFSMGDACPEEQDPEGRFVARLPSSFHLSRLPFLHKDDDGNKMTGVMPGTKVLILPPTATFLSFTLARNNHEGWVCFGKCLSLYLNDKELN

SEQ ID NO: 770168 - protein, 120 aa, Homo sapiens; identical to SEQ ID NO: 770153

SEQ ID NO: 770169 - protein, 222 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPNCPFLGQKLANLTRREP

SEQ ID NO: 770170 - protein, 135 aa, Homo sapiens; identical to SEQ ID NO: 770156

SEQ ID NO: 770171 - protein, 102 aa, Homo sapiens; identical to SEQ ID NO: 770154

SEQ ID NO: 770172 - protein, 102 aa, Homo sapiens; identical to SEQ ID NO: 770154

SEQ ID NO: 770173 - protein, 102 aa, Homo sapiens; identical to SEQ ID NO: 770154

SEQ ID NO: 770174 - protein, 148 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIGFKPGHSKAVKFPQACFQVLTIAVTFA

SEQ ID NO: 770175 - protein, 135 aa, Homo sapiens; identical to SEQ ID NO: 770156

SEQ ID NO: 770176 - protein, 127 aa, Homo sapiens
MNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAGTGPGLGAGGGARESGVSETG

SEQ ID NO: 770177 - protein, 135 aa, Homo sapiens; identical to SEQ ID NO: 770156

SEQ ID NO: 770178 - protein, 246 aa, Homo sapiens; identical to SEQ ID NO: 770161

SEQ ID NO: 770179 - protein, 989 aa, Homo sapiens
MWNCAALGQSHEARATFKITSGVTYNPNLQDKLSVDFKVLAFDLQQMIDEIFLSSNLKNEYKNSRVLQFENGSIIVVFDLFFAQWVSDENVKEELIQGLEANKSSQLVTFHIDLNSVDILASLENFSTVSPATTSDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFSTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 770180 - protein, 1019 aa, Homo sapiens
MGSKRGISSRHHSLSSYEIMFAALFAILVVLCAGLIAVSCLTIKESQRGAALGQSHEARATFKITSGVTYNPNLQDKLSVDFKVLAFDLQQMIDEIFLSSNLKNEYKNSRVLQFENGSIIVVFDLFFAQWVSDENVKEELIQGLEANKSSQLVTFHIDLNSVDILDKLTTTSHLATPGNVSIECLPGSSPCTDALTCIKADLFCDGEVNCPDGSDEDNKMCATVCDGRFLLTGSSGSFQATHYPKPSETSVVCQWIIRVNQGLSIKLSFDDFNTYYTDILDIYEGVGSSKILRASIWETNPGTIRIFSNQVTATFLIESDESDYVGFNATYTAFNSSELNNYEKINCNFEDGFCFWVQDLNDDNEWERIQGSTFSPFTGPNFDHTFGNASGFYISTPTGPGGRQERVGLLSLPLDPTLEPACLSFWYHMYGENVHKLSINISNDQNMEKTVFQKEGNYGDNWNYGQVTLNETVKFKVAFNAFKNKILSDIALDDISLTYGICNGSLYPEPTLVPTPPPELPTDCGGPFELWEPNTTFSSTNFPNSYPNLAFCVWILNAQKGKNIQLHFQEFDLENINDVVEIRDGEEADSLLLAVYTGPGPVKDVFSTTNRMTVLLITNDVLARGGFKANFTTGYHLGIPEPCKADHFQCKNGECVPLVNLCDGHLHCEDGSDEADCVRFFNGTTNNNGLVRFRIQSIWHTACAENWTTQISNDVCQLLGLGSGNSSKPIFSTDGGPFVKLNTAPDGHLILTPSQQCLQDSLIRLQCNHKSCGKKLAAQDITPKIVGGSNAKEGAWPWVVGLYYGGRLLCGASLVSSDWLVSAAHCVYGRNLEPSKWTAILGLHMKSNLTSPQTVPRLIDEIVINPHYNRRRKDNDIAMMHLEFKVNYTDYIQPICLPEENQVFPPGRNCSIAGWGTVVYQGTTANILQEADVPLLSNERCQQQMPEYNITENMICAGYEEGGIDSCQGDSGGPLMCQENNRWFLAGVTSFGYKCALPNRPGVYARVSRFTEWIQSFLH

SEQ ID NO: 770181 - protein, 44 aa, Homo sapiens
LHLNPRITVSYSGGLNRGANSKRILSPLGGCGRAPQSEFGGSTT

SEQ ID NO: 770182 - protein, 176 aa, Homo sapiens
MAMSFEWPWQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 770183 - protein, 176 aa, Homo sapiens; identical to SEQ ID NO: 770182

SEQ ID NO: 770184 - protein, 176 aa, Homo sapiens; identical to SEQ ID NO: 770182

SEQ ID NO: 770185 - protein, 192 aa, Homo sapiens
PKYVWGEPGVNQSRGCTMAISELARQYRFPPFFTLQPNVDTRQKQLAAWCSLVLSFCRLHKQSSMTVMEAQESPLFNNVKLQRKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 770186 - protein, 114 aa, Homo sapiens
MAMSFEWPWQYRFPPFFTLQPNVDTRQKQLAAWCSLVLSFCRLHKQSSMTVMEAQESPLFNNVKLQRILPQALPQPIHMHFCAFTHAQTPPRASPLLPMVGRFPPKLDLKSENV

SEQ ID NO: 770187 - protein, 176 aa, Homo sapiens; identical to SEQ ID NO: 770182

SEQ ID NO: 770188 - protein, 176 aa, Homo sapiens; identical to SEQ ID NO: 770182

SEQ ID NO: 770189 - protein, 176 aa, Homo sapiens; identical to SEQ ID NO: 770182

SEQ ID NO: 770190 - protein, 176 aa, Homo sapiens; identical to SEQ ID NO: 770182

SEQ ID NO: 770191 - protein, 128 aa, Homo sapiens [sequence omitted]

SEQ ID NO: 770192 - protein, 235 aa, Homo sapiens
MAMSFEWPWQYRFPPFFTLQPNVDTRQKQLAAWCSLVLSFCRLHKQSSMTVMEAQESPLFNNVKLQRILPQALPQPIHMHFCAFTHAQSPPAPAPFYPCKGHLFLLPDSSLKYLWRKAEGRQQTEGKLPVESIQIVLEELRKKGNLEWLDKSKSSFLIMWRRPEEWGKLIYQWVSRSGQNNSVFTLYELTNGEDTEDEEFHGLDEATLLRALQALQQEHKAEIITVSDGRGVKFF

SEQ ID NO: 770193 - protein, 162 aa, Homo sapiens [sequence omitted]

SEQ ID NO: 770194 - protein, 150 aa, Homo sapiens
MKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLRLAPLYASARALWLLVALAALGLLAHFLPAALRAALLGRLRTLLPWA

SEQ ID NO: 770195 - protein, 105 aa, Homo sapiens
MKGRRPCAAWSTCSRASATSRATRAPRSSGWHRCTRARAPSGCWWRWLRSACSPTSSRPRCAPRSSDGSGRCCRGPETKAPGPTEPGKKSRSLQLPRGGALASAS

SEQ ID NO: 770196 - protein, 260 aa, Homo sapiens
MKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLSEGRAGSGAGPGKDRGRAGLLGSGTEAGGGRRAGAQRLWGFGGRALAAARGSPRGARVAAGKKRASSRHLPADRRPQAGTAVRERARPLAAGGAGCARPARPLPPGRAARRAPRTAPDAAAVGLRPRPPGRRSRERRAGASSCPGEGRSLPHPSLYH

SEQ ID NO: 770197 - protein, 105 aa, Homo sapiens
MVTPPCTPSTEMGRGEHRGSASSPGPSSEQQTGLSVPQLAFTHSPCHHTDGTMKDEVALLAAVTLLGVLLQAYFSLQVISARRAFRVSPPLTTGPPEFERVYRAQ

SEQ ID NO: 770198 - protein, 150 aa, Homo sapiens; identical to SEQ ID NO: 770194

SEQ ID NO: 770199 - protein, 105 aa, Homo sapiens; identical to SEQ ID NO: 770195

SEQ ID NO: 770200 - protein, 160 aa, Homo sapiens
MKDEVALLAAVTLLGVLLQAYFSLQVISARRAFRVSPPLTTGPPEFERVYRAQGGGPVRPGLPVRAPPLLPGLRALRAAQAGTAVRERARPLAAGGAGCARPARPLPPGRAARRAPRTAPDAAAVGLRPRPPGRRSRERRAGASSCPGEGRSLPHPSLYH

SEQ ID NO: 770201 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 770202 - protein, 557 aa, Homo sapiens
MPPCQPQRPLLLLLLLLACQPQVPSAQVMDFLFEKWKLYGDQCHHNLSLLPPPTGEPPTQSLSACAWPQHFLSSLHGKVPGCLCSLGGPRQGALSFLRPPPPWAELVCNRTFDKYSCWPDTPANTTANISCPWYLPWHHKVQHRFVFKRCGPDGQWVRGPRGQPWRDASQCQMDGEEIEVQVSGRQAGAVGLDGNGHGGPCLALTGHCNSQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 770203 - protein, 82 aa, Homo sapiens
PQRTGRRTGADWLCHSKLHCTRNAIHANLFASFVLKASSVLVIDGLLRTRYSQKIGDDLSVSTWLSDGVSPLGGLRQVGGSA

SEQ ID NO: 770204 - protein, 83 aa, Homo sapiens
MLSVKLHGAVKLLVLPLEGAASQAAKETHIRVIRSHHSAEAGNSLHWPGFPPSGVESGCSYQGWMSSKCRQPGTRAAATNAGR

SEQ ID NO: 770205 - protein, 167 aa, Homo sapiens
MLPEKALHGHPQLPRTVPTRAAMRAAGTLLAFCCLVLSTTGGPSPDTCSQDLNSRVKPGFPKTIKTNDPGVLQAARYSVEKFNNCTNDMFLFKESRITRALVQIVKGLKYMLEVEIGRTTCKKNQHLRLDDCDFQTNHTLKQTLSCYSEVWVVPWLQHFEVPVLRCH

SEQ ID NO: 770206 - protein, 285 aa, Homo sapiens
MLPEKALHGHPQLPRTVPTRAAMRAAGTLLAFCCLVLSTTGGPSPDTCSQDLNSRVKPGFPKTIKTNDPGVLQAARYSVEKFNNCTNDMFLFKESRITRALVQIVKGLKYMLEVEIGRTTCKKNQHLRLDDCDFQTNHTLKQVKQQALLSDVPSLPQPTPSQDCEKHRHHVSNAAPQTSPLRKPGLPDSRTTEDPGEQEVEPVPGAPQMTSSRPRGGDTALEERPGVRVERVRVRKAFKQSRNYICIIYIHMICIICISYIAYLCRESKRTGTQQHLAITEVKST

SEQ ID NO: 770207 - protein, 84 aa, Homo sapiens
FQSDSASTCGDVPFFTWLLMLGGKANAENPRASTDPYKKDSTASYRFNYCFFMRNSKPQSLTIVYLLIPKRQTPTRHPPVYTSI

SEQ ID NO: 770208 - protein, 105 aa, Homo sapiens
EPRRQPSPFVSQTAPPPGATARGAPRKPCTGAARKGVDHSGGRRGFAQNLAGTVAFSRSAPKRLPSGLPPAWPTLAEGRRPGRRLCSPRFCERPQTGLRSLCLLE

SEQ ID NO: 770209 - protein, 97 aa, Homo sapiens
KKSHTPPAMILRPPQRCGTVLFLLGGQFELTGKGIVRTITGSTERKARGSFAIWSENQPPTPKAKLLPFQKLRDGGAIFLDDCTSERWFQVIEKDIP

SEQ ID NO: 770210 - protein, 285 aa, Homo sapiens
VQDRPVVIGRGQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770211 - protein, 87 aa, Homo sapiens
SYLTRVRIYQLSRKQLHLYDIESCSKTMILNFCSYMQWVPGSDVLVAQNRNSLCVWYNIEAPERVTMFTIRVCWTLGALRCGIELIN

SEQ ID NO: 770212 - protein, 1755 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770213 - protein, 1742 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKMWRRLSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770214 - protein, 1170 aa, Homo sapiens
MVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770215 - protein, 1739 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770216 - protein, 1763 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLAVLSPSSKCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770217 - protein, 1722 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770218 - protein, 1730 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLAVLSPSSKCENLVKSSEANSPAHEEFKTMLLIAHYYATRSAAQSVKQLETVAARLSVSLLRHTQLLPVDKAFYEAGIAAKAVGWDNMAFIFLNRFLDLTDEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770219 - protein, 1756 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKVREEDLENEGREGSTKKRKKNKSGCSGSYL

SEQ ID NO: 770220 - protein, 1714 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGIEAYSTPDPVVGRKQQDQ

SEQ ID NO: 770221 - protein, 1644 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVP

SEQ ID NO: 770222 - protein, 212 aa, Homo sapiens [sequence omitted]

SEQ ID NO: 770223 - protein, 78 aa, Homo sapiens
MKMELSEHLHRYEDYVDQHYKEFLKNQGKVDSVRLGELAGGRMQGETHKTLSLFFPSCHLFSLVTLSSIDPAGGCGCD

SEQ ID NO: 770224 - protein, 97 aa, Homo sapiens
FWNMKMELSEHLHRYEDYVDQHYKEFLKNQGKVDSVRLGELAGGRMQGETHKTLSLFFPSCHLFSLVTLSSIDPAGGCGCDSCFGPVCGAGPVGQVH

SEQ ID NO: 770225 - protein, 1821 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTVKFRPVPGTLDEQTYISISTYKYSQELHFYHLNVTFPTARMVLHGCSWSSAVFLRALLCPSLEEIESAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770226 - protein, 803 aa, Homo sapiens
MYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770227 - protein, 1812 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKVSWDKEGWGREEEVKGWKIEYPFCSGRGKLSVGLMFGGCSPPMSSWIFLPGSQRNSIQAQLAHSHLHLDPREVAFKPSLFTPICNSSLLQAVGWDNMAFIFLNRFLDLTDEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 770228 - protein, 1755 aa, Homo sapiens; identical to SEQ ID NO: 770212

SEQ ID NO: 770229 - protein, 1804 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKVSWDKEGWGREEEVKGWKIEYPFCSGRGKLSVGLMFGGCSPPMSSWIFLPGSQRNSIQAQLAHSHLHLDPREVAFKPSLFTPICNSSLLQAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGIEAYSTPDPVVGRKQQDQ

SEQ ID NO: 770230 - protein, 1605 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLVRCRGSKEHSVRRAHLQMYKAELIHVLDSSAWALESPHLSFSFSSV

SEQ ID NO: 770231 - protein, 586 aa, Homo sapiens
ERQVCVMHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRVCWTLGALRCGIELIN

SEQ ID NO: 770232 - protein, 110 aa, Homo sapiens
MNLSGGLAHHISPLGKWSKAGDNPTSPCNCVTCLFFLQLHLYDIESCSKTMILNFCSYMQWVPGSDVLVAQNRNSLCVWYNIEAPERVTMFTIRVCWTLGALRCGIELIN

SEQ ID NO: 770233 - protein, 404 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 770234 - protein, 382 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 770235 - protein, 404 aa, Homo sapiens; identical to SEQ ID NO: 770233

SEQ ID NO: 770236 - protein, 404 aa, Homo sapiens; identical to SEQ ID NO: 770233

SEQ ID NO: 770237 - protein, 154 aa, Homo sapiens
MFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 770238 - protein, 404 aa, Homo sapiens; identical to SEQ ID NO: 770233

SEQ ID NO: 770239 - protein, 404 aa, Homo sapiens; identical to SEQ ID NO: 770233

SEQ ID NO: 770240 - protein, 404 aa, Homo sapiens; identical to SEQ ID NO: 770233

SEQ ID NO: 770241 - protein, 124 aa, Homo sapiens
MKRTDVQGCGRMGRTGAAGLCKVSNLDDSLLNSYRNIPFCKWLVSQGVISYNMEWVCLGKGLHEGNGLNSFSPSPLFNNAVMDVQAFERLLGPCMDIMKRNISHYEEQLVKMFGSSVDLGNLGQ

SEQ ID NO: 770242 - protein, 404 aa, Homo sapiens; identical to SEQ ID NO: 770233

SEQ ID NO: 770243 - protein, 404 aa, Homo sapiens; identical to SEQ ID NO: 770233

SEQ ID NO: 770244 - protein, 275 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVKWLEEESV

SEQ ID NO: 770245 - protein, 274 aa, Homo sapiens
RPRACWRNEEDTDPREQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 770246 - protein, 377 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEERRYRSKGEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 770247 - protein, 404 aa, Homo sapiens; identical to SEQ ID NO: 770233

SEQ ID NO: 770248 - protein, 404 aa, Homo sapiens; identical to SEQ ID NO: 770233

SEQ ID NO: 770249 - protein, 404 aa, Homo sapiens; identical to SEQ ID NO: 770233

SEQ ID NO: 770250 - protein, 311 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEDGQRFNPHLHFASEGPFIRPLVKITPTQFLYLWFKTACLSNNLSA

SEQ ID NO: 770251 - protein, 404 aa, Homo sapiens; identical to SEQ ID NO: 770233

SEQ ID NO: 770252 - protein, 273 aa, Homo sapiens [sequence omitted]

SEQ ID NO: 770253 - protein, 552 aa, Homo sapiens
AGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770254 - protein, 273 aa, Homo sapiens [sequence omitted]

SEQ ID NO: 770255 - protein, 442 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770256 - protein, 596 aa, Homo sapiens
AGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHIEATSDGTLRDVHVPVICKDCRPRGKRNNLSLDLTMGEYPKSWIAVPGVDSKMKEGVSSPSNLKGVEASWWAASGTCAYKVQGVPTRFCIHGSVQMRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770257 - protein, 364 aa, Homo sapiens
GTQSREMDIAVLQRSPCYCHPRYWWRSEVDLPGTCVRRRTIVSCTAMIPSAYWVFGASRRQAGSADRYVPECVIAQLRHACVEDVWKEGRYAEEGVPCRVVETFEEMVQSDATRGHVRRQEGNGQGGRYHAKEVAIAGWVHRALKIKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770258 - protein, 510 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPEYPHRTKSPTVWSHDSISLKSRLSSLRLPGDSRGIPCPGNRRASPAAAQGGPPDERHEHQAGARPEDLRPHQHAQGLLGLVAARILAQGASSRLSRARQTFLRGPEMGPVGGQGLSLGA

SEQ ID NO: 770259 - protein, 138 aa, Homo sapiens [sequence omitted]

SEQ ID NO: 770260 - protein, 138 aa, Homo sapiens [sequence omitted]

SEQ ID NO: 770261 - protein, 442 aa, Homo sapiens; identical to SEQ ID NO: 770255

SEQ ID NO: 770262 - protein, 442 aa, Homo sapiens; identical to SEQ ID NO: 770255

SEQ ID NO: 770263 - protein, 442 aa, Homo sapiens; identical to SEQ ID NO: 770255

SEQ ID NO: 770264 - protein, 442 aa, Homo sapiens; identical to SEQ ID NO: 770255

SEQ ID NO: 770265 - protein, 442 aa, Homo sapiens; identical to SEQ ID NO: 770255

SEQ ID NO: 770266 - protein, 442 aa, Homo sapiens; identical to SEQ ID NO: 770255

SEQ ID NO: 770267 - protein, 418 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGKALGNSMSPRNSKERENERPSHHQED

SEQ ID NO: 770268 - protein, 409 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPAVRSQATPSTFCLKISLA

SEQ ID NO: 770269 - protein, 442 aa, Homo sapiens; identical to SEQ ID NO: 770255

SEQ ID NO: 770270 - protein, 323 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770271 - protein, 357 aa, Homo sapiens
MLFEVEERKFTVVWLCIETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770272 - protein, 440 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGLSFQGPEEGGQCSGIIDKTLGEKFPTQTQVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770273 - protein, 232 aa, Homo sapiens
MELGSEPIDGLKICQTAWLCSFCLRPISTMTTVTSPVPLSLKYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770274 - protein, 157 aa, Homo sapiens
MVCSPILKKTLCSQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 770275 - protein, 138 aa, Homo sapiens [sequence omitted]

SEQ ID NO: 770276 - protein, 136 aa, Homo sapiens
TNLRLGTRPRVKGRWHRRWGFMLVNIDSTGFLQSPNTLAPLSSPLSVPHFPGGIWSGLPNLSWVTSRAASRPGWRPRKPLPSFLPLLSPGLVNSSVVSFSPFSLFLQQPGFSPLHPLQVEREKLGPAGPCLLAQTP

SEQ ID NO: 770277 - protein, 442 aa, Homo sapiens; identical to SEQ ID NO: 770255

SEQ ID NO: 770278 - protein, 442 aa, Homo sapiens; identical to SEQ ID NO: 770255

SEQ ID NO: 770279 - protein, 442 aa, Homo sapiens; identical to SEQ ID NO: 770255

SEQ ID NO: 770280 - protein, 405 aa, Homo sapiens
RRMCLRGGCSPRAPAARARQPRPPPALPPRPRAPVPASRPGRPLLTPARPVRSDAPRQPRAPARRLPAERRRPARARDPARVGARPRGCVGPARPGPAGPWTETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPEYPHRHQIPDSLVP

SEQ ID NO: 770281 - protein, 217 aa, Homo sapiens
AGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHDEKGF

SEQ ID NO: 770282 - protein, 474 aa, Homo sapiens
MLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 770283 - protein, 581 aa, Homo sapiens
TWFRFASPRGPEWLAWSLCGAVSCTCLGIRREEAGTPGSQEMDSVAFEDVDVNFTQEEWALLDPSQKNLYRDVMWETMRNLASIGKKWKDQNIKDHYKHRGRNLRSHMLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 770284 - protein, 165 aa, Homo sapiens
ALGRLLNTLGEARKPREMAPSAAVPDRVLQRMHPPSLLPARPVGPAPILPEGPTGGEARGCCLSSGPFWRGAGCPQAESDGSFLLGAPGFPDSSRPGKAPGPLSRCPESLHFSSFATELIGRCASDRRARACAPPKTSGVPGRPPGRNEHHGERPASKTTSGTWT

SEQ ID NO: 770285 - protein, 113 aa, Homo sapiens
QNLALLPRLECNGMILAHSNLCLPGSSDSPVSASRVAGITGTCHHAQLIFVFLVETRFHHVGEAGLELTSNDPPSSASQSAGITGVSQRTRTRSRLLTWTYEPSENESTIARM

SEQ ID NO: 770286 - protein, 272 aa, Homo sapiens
QDPETEMSEGRSTGPCIWGVERRMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSIS

SEQ ID NO: 770287 - protein, 276 aa, Homo sapiens
GEKQKSIKRVPYFADGAELWLPEDSERMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSIS

SEQ ID NO: 770288 - protein, 143 aa, Homo sapiens
MVFKHFNGVPYLQSSPTYRQGMYDSGPHKIIGMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVEVRIKNNYCLY

SEQ ID NO: 770289 - protein, 109 aa, Homo sapiens
GTRDVGAAANVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSIS

SEQ ID NO: 770290 - protein, 281 aa, Homo sapiens
MVFKHFNGVPYLQSSPTYRQGMYDSGPHKIIGMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSIS

SEQ ID NO: 770291 - protein, 143 aa, Homo sapiens; identical to SEQ ID NO: 770288

SEQ ID NO: 770292 - protein, 143 aa, Homo sapiens; identical to SEQ ID NO: 770288

SEQ ID NO: 770293 - protein, 665 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770294 - protein, 665 aa, Homo sapiens; identical to SEQ ID NO: 770293

SEQ ID NO: 770295 - protein, 697 aa, Homo sapiens
DLKVLWAPHREFYFINSRLSVRSKRRSGGTGEPVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770296 - protein, 662 aa, Homo sapiens
CQVNQRDLQFSESTELIPAQSSDTARNYHFILHRMEVSAAKAPSAADLSEIEIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770297 - protein, 630 aa, Homo sapiens
FFPLTSPSSSISLFCNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770298 - protein, 498 aa, Homo sapiens
GHRRYYSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770299 - protein, 715 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNPHPQTPPENLVGCVEEVSQSPELLKIKLRLTSRTSPYSSKKPFKGYPAIRRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770300 - protein, 622 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770301 - protein, 665 aa, Homo sapiens; identical to SEQ ID NO: 770293

SEQ ID NO: 770302 - protein, 591 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGTSCDFSISPSFRLFMKLEMSSCLIFHQPS

SEQ ID NO: 770303 - protein, 665 aa, Homo sapiens; identical to SEQ ID NO: 770293

SEQ ID NO: 770304 - protein, 665 aa, Homo sapiens; identical to SEQ ID NO: 770293

SEQ ID NO: 770305 - protein, 427 aa, Homo sapiens
MGEETIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770306 - protein, 511 aa, Homo sapiens
ISSRHTSPHSTHLLTPRISPQRERRRSLCGGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770307 - protein, 432 aa, Homo sapiens
LSQYQHAVETIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770308 - protein, 571 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 770309 - protein, 209 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSNYWEEVTCNYSNSRLIKNRNGQQDKEQGLLQSNISI

SEQ ID NO: 770310 - protein, 815 aa, Homo sapiens
GTKLGAAKMRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 770311 - protein, 815 aa, Homo sapiens; identical to SEQ ID NO: 770310

SEQ ID NO: 770312 - protein, 815 aa, Homo sapiens; identical to SEQ ID NO: 770310

SEQ ID NO: 770313 - protein, 266 aa, Homo sapiens
ICGPSLGTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 770314 - protein, 815 aa, Homo sapiens; identical to SEQ ID NO: 770310

SEQ ID NO: 770315 - protein, 815 aa, Homo sapiens; identical to SEQ ID NO: 770310

SEQ ID NO: 770316 - protein, 815 aa, Homo sapiens; identical to SEQ ID NO: 770310

SEQ ID NO: 770317 - protein, 815 aa, Homo sapiens; identical to SEQ ID NO: 770310

SEQ ID NO: 770318 - protein, 815 aa, Homo sapiens; identical to SEQ ID NO: 770310

SEQ ID NO: 770319 - protein, 180 aa, Homo sapiens [sequence omitted]

SEQ ID NO: 770320 - protein, 876 aa, Homo sapiens
GTKLGAAKMRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGMAPKCQPGWSPGQAGFCTGLSLGPVKWDHYSIAYSCAEAAAEVAGESSEGLQVTGCNAYVDGVPQSTGLGGQPPACKPWSLKVLEKVFVGRKTAALPVPSVQQHIAKAAQAKSL

SEQ ID NO: 770321 - protein, 114 aa, Homo sapiens
GVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 770322 - protein, 251 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 770323 - protein, 251 aa, Homo sapiens; identical to SEQ ID NO: 770322

SEQ ID NO: 770324 - protein, 297 aa, Homo sapiens
MELLASCPRSRLSPWGGWAPPPSHSRDLRPLPQDDGWEGACGVCLSMEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 770325 - protein, 251 aa, Homo sapiens; identical to SEQ ID NO: 770322

SEQ ID NO: 770326 - protein, 195 aa, Homo sapiens [sequence omitted]

SEQ ID NO: 770327 - protein, 195 aa, Homo sapiens [sequence omitted]

SEQ ID NO: 770328 - protein, 210 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGKSGWSQNNYSHPPWCLHITPAP

SEQ ID NO: 770329 - protein, 251 aa, Homo sapiens; identical to SEQ ID NO: 770322

SEQ ID NO: 770330 - protein, 251 aa, Homo sapiens; identical to SEQ ID NO: 770322

SEQ ID NO: 770331 - protein, 251 aa, Homo sapiens; identical to SEQ ID NO: 770322

SEQ ID NO: 770332 - protein, 236 aa, Homo sapiens
LARSRTICPGLGGGLCEEPRGYQVNSEAACCLSVTNSGPQTQPGICRTPDKKALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLSVGTALLGLKEALLFNLGGKYSAFEPEGVLANVLGLLLACFGGAVLYILTRADWKRPSQAEEQALSMDFKTLTEGDSPGSQ

SEQ ID NO: 770333 - protein, 251 aa, Homo sapiens; identical to SEQ ID NO: 770322

SEQ ID NO: 770334 - protein, 251 aa, Homo sapiens; identical to SEQ ID NO: 770322

SEQ ID NO: 770335 - protein, 156 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQVSPSNTPGLGPPTREVGGGGE

SEQ ID NO: 770336 - protein, 106 aa, Homo sapiens
CEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVQ

SEQ ID NO: 770337 - protein, 37 aa, Homo sapiens
LFLTGQGEEESASLWISVCPMGKAFIQQEASCVASNG

SEQ ID NO: 770338 - protein, 140 aa, Homo sapiens
SCLLLGMLLLSPSPLRASLSLPGSLLLPLQTSLASLFIHTFRPGKRQLIQENTHPVGWGHCFLVLSVTLCDHRQVSASFWFCFFIYKLGRIIHVLPNTRLAFFSFLVATLLHPWMSAPEAEEQREKRRRRNPPRKQAGSK

SEQ ID NO: 770339 - protein, 210 aa, Homo sapiens
LSVRAPGVPAARPRLSSARQAGAGRGELRGQRLWWVRRCGCGAGQAGSMLRAVGSLLRLGRGLTVRCGPGAPLEATRRPAPALPPRGLPCYSSGGAPSNSGPQGHGEIHRVPTQRRPSQFDKKILLWTGRFKSMEEIPPRIPPEMIDTARNKARVKACYIMIGLTIIACFAVIVSAKRAVERHESLTSWNLAKKAKWREEAALAAQAKAK

SEQ ID NO: 770340 - protein, 210 aa, Homo sapiens; identical to SEQ ID NO: 770339

SEQ ID NO: 770341 - protein, 1022 aa, Homo sapiens
ATCSARRAAPGGIRRAGPARPGGPRAPEAMPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 770342 - protein, 793 aa, Homo sapiens
ATCSARRAAPGGIRRAGPARPGGPRAPEAMPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEG

SEQ ID NO: 770343 - protein, 1029 aa, Homo sapiens
ATCSARRAAPGGIRRAGPARPGGPRAPEAMPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAKLWKIPETMKAVKIAPQRENPPQRMPGKNKDKGNTKAARSPGTLQKF

SEQ ID NO: 770344 - protein, 287 aa, Homo sapiens
MLWCFNCFICETLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYL

SEQ ID NO: 770345 - protein, 366 aa, Homo sapiens
TNQSYQESHCFSFSSHYPHGINTAVYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLVCLNILVMW

SEQ ID NO: 770346 - protein, 474 aa, Homo sapiens
TNQSYQESHCFSFSSHYPHGINTAVYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYL

SEQ ID NO: 770347 - protein, 465 aa, Homo sapiens
MGEMLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 770348 - protein, 118 aa, Homo sapiens [sequence omitted]

SEQ ID NO: 770349 - protein, 81 aa, Homo sapiens
MAWSPPATLFLFLLLLGQPPPSRPQSLGTTKLRLVGPESKPEEGRLEVLHQGQWGTVCDDNFAIQQHHQDSSTTRTAAPPG

SEQ ID NO: 770350 - protein, 756 aa, Homo sapiens [sequence omitted]

SEQ ID NO: 770351 - protein, 756 aa, Homo sapiens [sequence omitted]

SEQ ID NO: 770352 - protein, 112 aa, Homo sapiens [sequence omitted]

SEQ ID NO: 770353 - protein, 124 aa, Homo sapiens
LEQAGKKEKEQSCSWGQIFGGFIRFSVNQWGLARTGVRRGHGRERIVKESSNILARATGRTKLPHRWAEAQCWTHRITCTPIRYPSGDTKCGAEVADLGFRGDTYLWVKAGSLQDPTSRVHAPV

SEQ ID NO: 770354 - protein, 953 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770355 - protein, 953 aa, Homo sapiens; identical to SEQ ID NO: 770354

SEQ ID NO: 770356 - protein, 912 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770357 - protein, 824 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770358 - protein, 953 aa, Homo sapiens; identical to SEQ ID NO: 770354

SEQ ID NO: 770359 - protein, 953 aa, Homo sapiens; identical to SEQ ID NO: 770354

SEQ ID NO: 770360 - protein, 953 aa, Homo sapiens; identical to SEQ ID NO: 770354

SEQ ID NO: 770361 - protein, 223 aa, Homo sapiens
MYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770362 - protein, 167 aa, Homo sapiens
DLWEQSRLLARNPCPLGRGHGFWLLALLSSLASLLSQAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770363 - protein, 696 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRTAKFSGLPRDIIENY

SEQ ID NO: 770364 - protein, 410 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRKYDFNIHI

SEQ ID NO: 770365 - protein, 953 aa, Homo sapiens; identical to SEQ ID NO: 770354

SEQ ID NO: 770366 - protein, 392 aa, Homo sapiens
ECHTGDAVSWSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770367 - protein, 953 aa, Homo sapiens; identical to SEQ ID NO: 770354

SEQ ID NO: 770368 - protein, 223 aa, Homo sapiens; identical to SEQ ID NO: 770361

SEQ ID NO: 770369 - protein, 211 aa, Homo sapiens
MTSPSRQPRPRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 770370 - protein, 704 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSSS

SEQ ID NO: 770371 - protein, 742 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKLRLVQKCAWVRTQAHFSLPSQIHPVYTTCLARRSTLSTLPSLPVMHAIYTICLASRSTLSILPSLSSRPTLSILPPGQQIQPVYYYLTGQQIHLSTLPACTEVRLGQ

SEQ ID NO: 770372 - protein, 31 aa, Homo sapiens
MQLYTHVSENLPPYARPRFLRLQESLATTET

SEQ ID NO: 770373 - protein, 733 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPAGQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 770374 - protein, 701 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQRL

SEQ ID NO: 770375 - protein, 801 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGAYGMEGGGGTQPPPRIGSTWAQGARGLRGGQPWRGLLCLPHPPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 770376 - protein, 657 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGA

SEQ ID NO: 770377 - protein, 142 aa, Homo sapiens
MEGGGGTQPPPRIGSTWAQGARGLRGGQPWRGLLCLPHPPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 770378 - protein, 368 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKMWPLLMLLLALGLLGLPALTPGRVPDRAVWLARPLGPWASRSDLVETLYAQCKCRAGPLGEAKPNPRYSPSKFYNLGGFLWPGRPGLILKAAETRSQGERRGLGGKRPVGPSGKRRKEGLLREHPKMGLGGPILWARAPSAWTPLFLHPALNHGFRPLAQLKGEDPFGRAGNPIWAAERENPPPLENRGGSREWSRGKPKRGAPRVVPGEKRARQSGAERGPGGPPLWGAAERGNKNGRAQYEQDLGGECP

SEQ ID NO: 770379 - protein, 202 aa, Homo sapiens
MPKPPKPRNNLEDRHNPGIQGRREHRPGPGRVRAASSPGGSAPRAERRLWGEGWESGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAEL

SEQ ID NO: 770380 - protein, 757 aa, Homo sapiens
MSGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 770381 - protein, 757 aa, Homo sapiens; identical to SEQ ID NO: 770380

SEQ ID NO: 770382 - protein, 441 aa, Homo sapiens
MGLVAPESITQRMRQSAGVGGGEIASAAGDDVKKAALYCGLCRFRKKVSWPVAAMVHCSCVLFRKYGNFIDKLRLFTRGGSGGMGYPRLGGEGGKGGDVWVVAQNRMTLKQLKDRYPRKRFVAGVGANSKISALKGSKGKDWEIPVPVGISVTDENGKIIGELSKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 770383 - protein, 241 aa, Homo sapiens
MGLVAPESITQRMRQSAGVGGGEIASAAGDDSKKAALYCGLCRFRKKVSWPVAAMVHCSCVLFRKYGNFIDKLRLFTRGGSGGMGYPRLGGEGGKGGDVWVVAQNRMTLKQLKDRYPRKRFVAGVGANSKISALKGSKGKDWEIPVPVGISVTDENGKIIGELSKENDRILVAQGGLGGKLLTNFLPLKGQKRIIHLDLKLIADVGLVGFPNAGKSSLLSCVSHAKPAIADYAYTTFKPET

SEQ ID NO: 770384 - protein, 441 aa, Homo sapiens; identical to SEQ ID NO: 770382

SEQ ID NO: 770385 - protein, 214 aa, Homo sapiens
MGLVAPESITQRMRQSAGVGGGEIASAAGDDSKKAALYCGLCRFRKKVSWPVAAMVHCSCVLFRKYGNFIDKLRLFTRGGSGGMGYPRLGGEGGKGGDVWVVAQNRMTLKQLKDRYPRKRFVAGVGANSKISALKGSKGKDWEIPVPVGISVTDENGKIIGELSKENDRILVAQGGLGGKLLTNFLPLKGQKRIIHLDLKLIADVGLVGYNIKA

SEQ ID NO: 770386 - protein, 150 aa, Homo sapiens
MGLVAPESITQRMRQSAGVGGGEIASAAGDDSKKAALYCGLCRFRKKVSWPVAAMVHCSCVLFRKYGNFIDKLRLFTRGGSGGMGYPRLGGEGGKGGDVWVVAQNRMTLKQLKDRYPRKRFVAGVGANSKISALKGSKGKDWEIPVPVYL

SEQ ID NO: 770387 - protein, 229 aa, Homo sapiens
MGPLLFLPPREGCGHRVTAWWATPPRRHAQSGGRWGDPLHRALRDPSLRSPNLWRCPSTTDTGDPTSDAGPYHLRGMHATEAAICCLCRIALSSWLAEVVRITYITPWTGGYLAHQPGIMTDADPLAGGMLGQHDGQATLYPSGSPTRHRHPDTMTLWSGTDPDTSWGDLGHLLWSSPPGIRSLGIRPGTMAFSPDLIATATYNNRGADAKELQTQQTVARLVPHLYRT

SEQ ID NO: 770388 - protein, 146 aa, Homo sapiens
YQYGNYSWDLADEQNVSAATSTQAAGDRSPSPGPEGEGSQGRGCPNPVSCAQVNGFNTLGENIADNGGVRQAYKAYLKWMAEGGKDQQLPGLDLTHEQLFFINYAQVAAAVLVPPSPCFPTHLWRAHSGAPPGTRAQHGRPLGGKA

SEQ ID NO: 770389 - protein, 159 aa, Homo sapiens
LPVRQLLLGPGRRTERERCHQHPGCGGTGAPALALREKEVRAGAAPILSPVRRPTSSGWQRVARTSSCPAWISPMSSSSSSTMPRWQPQSWSHHPHASPLISGGPTLGHLQGPEPSMEGPLGEKHEGQGAGAGQDFNGDGRRGAPADSPHPTLEGAAWG

SEQ ID NO: 770390 - protein, 128 aa, Homo sapiens [sequence omitted]

SEQ ID NO: 770391 - protein, 187 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKV

SEQ ID NO: 770392 - protein, 66 aa, Homo sapiens
ARSGFWRGWVPCGGRAPPGHARCSEGARQPGARLGDFPRRWRSLLIEAAADHPNSLQATYCKTILL

SEQ ID NO: 770393 - protein, 86 aa, Homo sapiens
YRTNETCIHIGGTQRGPYHWVSQEESELCLSHTDNQPVPSQSPKKLTRSPNNGNQDMSAWFNLFADLDPLSNPDAIGHSDDELLNA

SEQ ID NO: 770394 - protein, 482 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMMSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNWVSQEESELCLSHTDNQPVPSQSPKKLTRSPNNGNQDMSAWFNLFADLDPLSNPDAIGHSDDELLNA

SEQ ID NO: 770395 - protein, 530 aa, Homo sapiens
MDDLQSQNLSMDMTDSPPALANNRLENGMAQLITTEAWNINSTDLVKKALVTVPAPSILNPPAESQSGMALKVAATVLQPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPVPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 770396 - protein, 530 aa, Homo sapiens; identical to SEQ ID NO: 770395

SEQ ID NO: 770397 - protein, 496 aa, Homo sapiens
MDDLQSQNLSMDMTDSPPALANNRLENGMAQLITTEAWNINSTDLPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPVPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 770398 - protein, 124 aa, Homo sapiens
RHRTGQSPDLPFCPGPENPAPSRPFERWILLTYLAALASLVESWVLPDCAGLLFVTRGQPRIPPGAGLPRKNEAVNLHKACLDFSPLGEEDHIKKGGRLAWTQNSTTKQTSFLRTSEFMIQVSQ

SEQ ID NO: 770399 - protein, 104 aa, Homo sapiens
KTLTNTPGQSERWQKAVLVHFPLLCGSCTYLPSRLPAQILTQGLEGTAWDLCSPPPLAGYVSLAKPPLSSFHVLICRVGKEQCARPPVVLSLPGQSPGERPSVT

SEQ ID NO: 770400 - protein, 93 aa, Homo sapiens
RAGWYGPGVRIEHQSPQLSALLVAEALYCVTMTWIWKQKGASKDRKLRVCLLSRPGHWGSGTRASVSAGVAGCFLMQLEQNGMSWDNRDVYPS

SEQ ID NO: 770401 - protein, 69 aa, Homo sapiens
ENREVDAQRENGEQTEKEAKNNLQGKHNIQGTRKRIEASKVEKEGQIREEKSHEIPLRSHGIKHLQCPS

SEQ ID NO: 770402 - protein, 822 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 770403 - protein, 880 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 770404 - protein, 791 aa, Homo sapiens
MLSSEPHAFPWKPGPWSCCFCPGLLWSPPRALPGLEEALVSVELSTSRHEGGGCTVACCAPLGAIAGPCVPSTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 770405 - protein, 133 aa, Homo sapiens
TVAAAANMAETSEEVAVLVQRVVKDITNAFRRNPHIDEIGLIPCPEARYNRSPIVLVENKLGVESWCVKFLLPYVHNKLLLYRTRKQWLNRDELIDVTCTLLLLNPDFTTAWNVRYVIFISDMIKFVQISEDM

SEQ ID NO: 770406 - protein, 71 aa, Homo sapiens
SLISQTVIDSSVMEQNPLRSEPALVPPKDEEAAVSTEEPRINLPHLLEEEVEFSTDLIDSYPGHETLWCHR

SEQ ID NO: 770407 - protein, 248 aa, Homo sapiens
TVAAAANMAETSEEVAVLVQRVVKDITNAFRRNPHIDEIGLIPCPEARYNRSPIVLVENKLGVESWCVKFLLPYVHNKLLLYRTRKQWLNRDELIDVTCTLLLLNPDFTTAWNVRKELILSGTLNPIKDLHLGKLALTKFPKSPETWIHRRWVLQQLIQETSLPSFVTKGNLGTIPTERAQRLIQEEMEVCGEAAGRYPSNYNAWSHRIWVLQHLAKLDVKVGILLSPGQTACLPLKSSGSSSFSEEL

SEQ ID NO: 770408 - protein, 109 aa, Homo sapiens
MGSRRFTCCATEPRLPSMMCPCGGIIGKQPFSDSQRTNELQKEIRQGRIAFGEKPLTRLALVFANNVSLNCCQIFFSLCRIHQSSYAKEHHCTALLKIHTIKWTLTCKT

SEQ ID NO: 770409 - protein, 157 aa, Homo sapiens
ICHPLRYPVIMNPHLCVFLVLVSFILSLLNSQLHNQIVLQFTCFKNVEIFNFFCEPSQLLNLACSDSVINNIFMYLDSVIFGFLPISGILLSYYKIVSSILRIPSSDGKYKAFSTCGSHLAVVCLFYGTGLGAYLSSAASSFPRKGAVTSVMYTVVI

SEQ ID NO: 770410 - protein, 81 aa, Homo sapiens
PLPPLPLIPVRTHLQLPGEKRTPPIRSPTQACAQRRGQPGPESNWKNMQAVKTNERGNLRLGCIAERRTDASRESEQTQQL

SEQ ID NO: 770411 - protein, 219 aa, Homo sapiens
HLRSSGQREGEQGGSPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKGPKRGADLHPESSQVAHQP

SEQ ID NO: 770412 - protein, 264 aa, Homo sapiens
HLRSSGQREGEQGGSPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRVTALGKGCVTRAPWRDTTTTAGPSGAWRKGQGTWLL

SEQ ID NO: 770413 - protein, 264 aa, Homo sapiens; identical to SEQ ID NO: 770412

SEQ ID NO: 770414 - protein, 80 aa, Homo sapiens
MQEGGCGTTAFRPGTPFSSSSQSPTDGVSPKFQRPYFGSGLGGRTTTYPLSSLETRATWPAPGRYHWRVCILNRFHTCDL

SEQ ID NO: 770415 - protein, 135 aa, Homo sapiens
GVGKSTLAGTFGGLQGDSAHEPENPEDTYERRIMVDKEEVTLVVYDIWEQGDAGGWLRDHCLQTGDAFLIVFSVTDRRSFSKVPETLLRLRAGRPHHDLPVILVGNKSDLARSREVSLEEGRHLAGTLSCKHIET

SEQ ID NO: 770416 - protein, 181 aa, Homo sapiens
LGRVYVYLGGLKGTWGETKPAMAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASS

SEQ ID NO: 770417 - protein, 134 aa, Homo sapiens
LGRVYVYLGGLKGTWGETKPAMAAAEEEDGGPEGPNRERGGAGATFECNICLETAREAVVSVCGHLYCWPCLHQWLETRPERQECPVCKAGISREKVVPLYGRGSQKPQDPRLKILIWCWCFSLWLFHHRLQCP

SEQ ID NO: 770418 - protein, 201 aa, Homo sapiens
LGRVYVYLGGLKGTWGETKPAMAAAEEEDGGPEGPNRERGGAGATFECNICLETAREAVVSVCGHLYCWPCLHQWLETRPERQECPVCKAGISREKVVPLYGRGSQKPQDPRLKNSSHLVIPGASTSHLVLVLFPLAFSPPSSMPMSLSAGVQVWIWDRVTQPPADRIPSSCFSPSSSFFGCSVFELCLLPAHLQPEENQY

SEQ ID NO: 770419 - protein, 201 aa, Homo sapiens; identical to SEQ ID NO: 770418

SEQ ID NO: 770420 - protein, 140 aa, Homo sapiens
FKHRKQFQKEIRESKEWLMLRLGSSDLICALRESVPGSAVWLLSAQLFFFFNYYYYYTLSFRVHVYNVQVSYICIHVPCWCTAPTNSSSSIRYISQCYPSPLPPPHNSPQSVMFPFLCPCVLIRSALILGDGAQAWGSID

SEQ ID NO: 770421 - protein, 87 aa, Homo sapiens
LLFLFFEGAPKTHTWGKRRLLELRVKMPKLHGRRSALPAKDVQEDFYQIRLNVPQCQLITPVVRKTTWHFWVSGIFENKSKGRRDIY

SEQ ID NO: 770422 - protein, 57 aa, Homo sapiens
MNDPSSGVSGVLAGEPKAGRSGPAAHWGLDATVELPLAQRENKQSHPGRGDGTRVAG

SEQ ID NO: 770423 - protein, 96 aa, Homo sapiens
TPISSPDLSSQLQICESNCQPDFASQIPQRHLKLSMSKSELTISTLKLASSSICHLERNNPLSRRSNSQELRSHPCPSPTSNQSLRPVDYTRLNSS

SEQ ID NO: 770424 - protein, 144 aa, Homo sapiens
GEPGACWGRAFQQRHGHVRRPRGRDELWEHEACQEGRGPEGVKTRRVGGPELVPSGPGGLQPTHPERRGRELTLAMGCPCQEFGTIWRQQRLRGSATYLTTHSGAGGSAAHLQGKLIAGCCCQVGLSAFYPLDLSCLGWGGGHN

SEQ ID NO: 770425 - protein, 106 aa, Homo sapiens
MSICFEHHVGVQNVPDFGFQIFEIQPVIINFNDCGCYSYNHHCYNCHHHHCYHCRTNGSSKVWSCVGPLIADLTPDGDAITQREKGAWSRSPSKSTPGWEEDHKDH

SEQ ID NO: 770426 - protein, 115 aa, Homo sapiens
DVLVVAALALRTLRLRQRGLAAPAPARPRPPTSCLSPNTAALPCGGPFSVSPARPVHFGRHERPVPPGSPGWLPGAPQGGHPKGAECPRRGWHDPHSLGCLPWQPRVAASHCEPR

SEQ ID NO: 770427 - protein, 604 aa, Homo sapiens
SRRSRARLPRKTTGLAGRRARCAIPGGGGNGGGDGGDCSGRLSPLPCAPASRRAAEQPAVPGSPSPRAHGRAQRTIAATAMGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 770428 - protein, 559 aa, Homo sapiens
SRRSRARLPRKTTGLAGRRARCAIPGGGGNGGGDGGDCSGRLSPLPCAPASRRAAEQPAVPGSPSPRAHGRAQRTIAATAMGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITIRDRFRTMVNVLGDAFGTGIVEKLSKKELEQMDVSSEVNIVNPFALESTILDNEDSDTKKSYVNGGFAVDKSDTISFTQTSQF

SEQ ID NO: 770429 - protein, 604 aa, Homo sapiens; identical to SEQ ID NO: 770427

SEQ ID NO: 770430 - protein, 383 aa, Homo sapiens
MLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 770431 - protein, 508 aa, Homo sapiens
SRRSRARLPRKTTGLAGRRARCAIPGGGGNGGGDGGDCSGRLSPLPCAPASRRAAEQPAVPGSPSPRAHGRAQRTIAATAMGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITIRWGMVSHSLSSLIQGLPPVKIVHEGTPRMSQ

SEQ ID NO: 770432 - protein, 211 aa, Homo sapiens [sequence omitted]

SEQ ID NO: 770433 - protein, 169 aa, Homo sapiens
SSRQYGERPPAPPWTQPSVPRRGAATWGQEKAEYATPLGTQEARRASGGRGGVDHGDQGLSPCCGDGGARGRRRLPTFWPSGLLRLRLDSLGALPPEPSRAGRGRLFGLSVVLLKRNAGGEATPREGGPRRRWLRESCSPLPARHSRRRASWVSRWMEGAPPRMPSLPL

SEQ ID NO: 770434 - protein, 159 aa, Homo sapiens
VCLSGCLGLWFAEGCMEAMPSSPAPALGSHRRPELRTTSQRRILTQSESNVTHTLSSTNKRATKPETSSSAALACVPGVPSAAGHGRDGVKQKGPAVTTLIPEEPLCWHERKSQGKGLFKVRLHQWKVSTSPQGSRQPVPFPLTVPTLTRGRLTRNKGP

SEQ ID NO: 770435 - protein, 134 aa, Homo sapiens [sequence omitted]

SEQ ID NO: 770436 - protein, 43 aa, Homo sapiens
VTPEFQVPMAMGKWAEHPQANASKISPFAILTKLCNTCANIFL

SEQ ID NO: 770437 - protein, 551 aa, Homo sapiens
SFFILQLVPELWILNWKKMSIQVEHPAGGYKKLFETVEELSSPLTAHVTGRIPLWLTGSLLRCGPGLFEVGSEPFYHLFDGQALLHKFDFKEGHVTYHRRFIRTDAYVRAMTEKRIVITEFGTCAFPDPCKNIFSRFFSYFRGVEVTDNALVNVYPVGEDYYACTETNFITKINPETLETIKQVDLCNYVSVNGATAHPHIENDGTVYNIGNCFGKNFSIAYNIVKIPPLQADKEDPISKSEIVVQFPCSDRFKPSYVHSFGLTPNYIVFVETPVKINLFKFLSSWSLWGANYMDCFESNETMGVWLHIADKKRKKYLNNKYRTSPFNLFHHINTYEDNGFLIVDLCCWKGFEFVYNYLYLANLRENWEEVKKNARKAPQPEVRRYVLPLNIDKADTGKNLVTLPNTTATAILCSDETIWLEPEVLFSGPRQAFEFPQINYQKYCGKPYTYAYGLGLNHFVPDRLCKLNVKTKETWVWQEPDSYPSEPIFVSHPDALEEDDGVVLSVVVSPGAGQKPAYLLILNAKDLSEVARAEVEINIPVTFHGLFKKS

SEQ ID NO: 770438 - protein, 147 aa, Homo sapiens
LPSPLHKAGQGWSGGLPGTQATSRPLRGRPFLVSAPSATADLVDEEEPLALARKAATVGACEEPGDVAQLRAAQLSAGVGVGAGRPSQSPPDIPSPLLPNNSALLRQGPTFQNTFSVARKKASPVSAYPPVPISKGQGTRVLWAQAH

SEQ ID NO: 770439 - protein, 167 aa, Homo sapiens
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 770440 - protein, 217 aa, Homo sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 770441 - protein, 217 aa, Homo sapiens; identical to SEQ ID NO: 770440

SEQ ID NO: 770442 - protein, 207 aa, Homo sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTS

SEQ ID NO: 770443 - protein, 217 aa, Homo sapiens; identical to SEQ ID NO: 770440

SEQ ID NO: 770444 - protein, 217 aa, Homo sapiens; identical to SEQ ID NO: 770440

SEQ ID NO: 770445 - protein, 217 aa, Homo sapiens; identical to SEQ ID NO: 770440

SEQ ID NO: 770446 - protein, 188 aa, Homo sapiens
SLITVSGWHLVSGGCSFDNSNFFMVVKVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 770447 - protein, 128 aa, Homo sapiens
RPPLYLQASIRPLSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 770448 - protein, 217 aa, Homo sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTGPSCPRLEQLS

SEQ ID NO: 770449 - protein, 235 aa, Homo sapiens
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLRGNAPREPGGPRKPRKKNPFLNLRPGKISYPFYNPGWSVGETIALFVVSFSQVLLLKSFFTEKRPISRAVHS

SEQ ID NO: 770450 - protein, 738 aa, Homo sapiens
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAFAGPGAPRLPRARFPGGPAAAAWAGDEAWRRGPAAPPGDKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAVARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 770451 - protein, 368 aa, Homo sapiens
MTEIEKYASKVDHVMQLARKEAVARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 770452 - protein, 110 aa, Homo sapiens [sequence omitted]

SEQ ID NO: 770453 - protein, 723 aa, Homo sapiens
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAFAGPGAPRLPRARFPGGPAAAAWAGDEAWRRGPAAPPGDKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAVARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 770454 - protein, 738 aa, Homo sapiens; identical to SEQ ID NO: 770450

SEQ ID NO: 770455 - protein, 106 aa, Homo sapiens
GIGKIMDQSKVLSHIKWSGVTRRLAEDLTTSNSDRLIEETISIAMAKESFAQEECGVIHANEHFGHRFPAVNSLIQRINLRKRRDSLILGGVIGICTILLLLYAFH

SEQ ID NO: 770456 - protein, 181 aa, Homo sapiens
MAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 770457 - protein, 232 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMAKESFANRFPAVNSLIQRINLRKRRDSLILGGVIGICTILLLLYAFH

SEQ ID NO: 770458 - protein, 150 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTTCIPSTPSQLYVYTRNGPIFMDSLLKIRSVC

SEQ ID NO: 770459 - protein, 132 aa, Homo sapiens [sequence omitted]

SEQ ID NO: 770460 - protein, 250 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 770461 - protein, 175 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQVIYWARDVFIITGVWVFFFNPCIGYVHIYLKGQREKSEKINAMLKGLVLLFFGVTIIKF

SEQ ID NO: 770462 - protein, 233 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSHPRKGGTPHLGGVFGTGPSRWWWMGQWWEI

SEQ ID NO: 770463 - protein, 110 aa, Homo sapiens
MAASQGNFVFTCFWKEHTELARAGLCFPLCSFLLPRMQMRWQVPQQPSPTIRHGFLTFGSGSTETEGRGLGVRWWHLHHRPTDSVSSPSGKVTEMKSLPYGRQGYSEFSV

SEQ ID NO: 770464 - protein, 386 aa, Homo sapiens
GTRGVSGWRGSLFGASPLNPSWGHGGQPDTPARMELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 770465 - protein, 424 aa, Homo sapiens
FLPICSPEGCLLCTWVLEPFSTRIDSSPLARLCPTLLCPEVQEPKPPPWPQEGFRGEAPNREPRQPDTPARMELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 770466 - protein, 319 aa, Homo sapiens
GTRGVSGWRGSLFGASPLNPSWGHGGQPDTPARMELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKDFWIVGDKLHCLSQNYWLWASEVAAGIQSQDSWSAEPNLQVPGPNPRIPEQDTRTLEWNSWTLSWTLTQDPRSPGHFLRNIRHRLPATQPPAWIFSFPNPSSYWTVYALPSSTHLAHPCGPAPPPAS

SEQ ID NO: 770467 - protein, 169 aa, Homo sapiens
GTRGVSGWRGSLFGASPLNPSWGHGGQPDTPARMELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQTREA

SEQ ID NO: 770468 - protein, 122 aa, Homo sapiens [sequence omitted]

SEQ ID NO: 770469 - protein, 76 aa, Homo sapiens
SPSSPTFPLILLPLILLQLPLTTNDFHISSPVLTVLQNPTRGLSGVLNNATRICVIASHVLSSAIHYVRPQGPKEG

SEQ ID NO: 770470 - protein, 160 aa, Homo sapiens
SRVSGARAGCHDPNPPGGRGPAGKANEYPLPLHRLPVGFLCKARRRVLKSAINATRCKASKCGAIHVYVGNRFSIKVQVERRGLHIFISIYLLRRNLILSPRLECSGAISTRCFPPLPGFRRFLCLSLPSSWDYRHAPLLLANFCIFSSRSGCSRTPDLK

SEQ ID NO: 770471 - protein, 222 aa, Homo sapiens
LKYGAFVPPELFGSEFFMGRLMRRIPEPRICFLEAIWSNIFSLNLLDAWYDLTSSGESWKQHIKDKTRSLEKEPLTTSGTSSRLEASWLQPGTALAQAFKGFLTGRPLHQRSPNFLQGLQLHQDYCSHKDFSTWADYQLDSMPSQLTPKEPRLCLVDAAYFINTSSPSMFRPGRRLDLILSFDYSLSAPFEVPWSPQGNPSAQPGQAPEASSRATEPLPHTA

SEQ ID NO: 770472 - protein, 136 aa, Homo sapiens
MNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNINRRCIRKKEQDSFTTSSASHNTSEEVPTLAP

SEQ ID NO: 770473 - protein, 170 aa, Homo sapiens
RITINGESPKHRSWHTLTPIADDKLFLCGGLSADNIPLSDGWIHNVTTNCWKQLTHLPKTRPRLWHTACLGKENEIMVFGGSKDDLLALDTGHCNDLLIFQTQPYSLLRSCLDCIGKNSIMLESQISLLPPKLLQQVLKKITFWAAANHREEQRVQKEETENKYQWISSN

SEQ ID NO: 770474 - protein, 205 aa, Homo sapiens
IQILPAEKLPSILPWTPDPGLEELFTALSPSLKPCAMSLQKRVFPRRQNGTHEVAAKPCPVATRQPRARDQERKKGSFTSSLRMESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKSRSTK

SEQ ID NO: 770475 - protein, 103 aa, Homo sapiens
MLPLWKLLHVSLYPQSMAAVIRIPQGGADEDPCTSVPVPLIRDLGWGVPICTCSFSSHALCRSLCRVSIILIRSTGDAGDSVIIVPLEGQRQSVCADLILGEC

SEQ ID NO: 770476 - protein, 103 aa, Homo sapiens
MSQENTKNKTKTPLALPNEKATSLNCRAFWQLRVFTPRETAALAPAGKTGLPSTPPRLPSPSGGFFSASSQTERRQVTEQGLNRSHARLSWGRPLQITLANLN

SEQ ID NO: 770477 - protein, 103 aa, Homo sapiens
AHSGQASEPASCTRPPGDYSAGITGKSHCTQLLCTFKTLQMIPRLGASALAEVPMMWTRGLLMQQEHSLAPALCHLGTPARAPLHAWQIRACELPISSPLPLM

SEQ ID NO: 770478 - protein, 386 aa, Homo sapiens
GLPETSHKLNRESGLNKDAFPQYIHNMLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 770479 - protein, 400 aa, Homo sapiens
GLPETSHKLNRESGLNKDAFPQYIHNMLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 770480 - protein, 186 aa, Homo sapiens
MEQPKDGAGPEGNNLSLPSSGTEPWPPAPLPAPPPLLLNSTDPTHLGLPESVASVTVPIRLDTLSCLLHSALLGAYTFQQALPSCPCCSQAGHSQPGAVRRPPRGRGGWEVRHRPGWGRGLHRRGLGRAEQPERGRAGGPGAGPRTPPMTLPSPPTLPAQDGKKEARGPEPPLETPLAAEDWETEY

SEQ ID NO: 770481 - protein, 151 aa, Homo sapiens
MSSGSNSSQQLDLLSQLVNTANGRPGTMRSSPEEPCPHPLGSRSEAYRGCLHKPHQNRGRPPAGDPHCIPRLRGSTCSSGEKFSECFADKIDQMQARLPAAGAACACGGPTSAGHQRLGVRGRPLSAPPPPKPVREGKTPKSTDWAVKEDE

SEQ ID NO: 770482 - protein, 183 aa, Homo sapiens
MNGFSTEEDSREGPPAAPAAAAPGYGQSCCLIEDGERCVRPAGNASFSKRVQKSISQKKLKLDIDKSVRHLYICDFHKNFIQSVRNKRKRKTSDDGGDSPEHDTDIPEVDLFQLQVNTLRRYKRHYKLQTRPGFNKAQLAETVSRHFRNIPVNEKETLAYFIYMVKSNKSRLDQKSEGGKQLE

SEQ ID NO: 770483 - protein, 123 aa, Homo sapiens
MNGFSTEEDSREGPPAAPAAAAPGYGQSCCLIEDGERCVRPAGNASFSKRVQKSISQKKLKLDIDKSVRHLYICDFHKNFIQSVRNKRKRKTSDDGGDSPEHDTDIPEVKVKETSCGSWKNGF

SEQ ID NO: 770484 - protein, 113 aa, Homo sapiens
MNGFSTEEDSREGPPAAPAAAAPGYGQSCCLIEDGERCVRPAGNASFSKRVQKSISQKKLKLDIDKSVRHLYICDFHKNFIQSVRNKRKRKTSDDGGDSPEHDTDIPECSPPA

SEQ ID NO: 770485 - protein, 183 aa, Homo sapiens; identical to SEQ ID NO: 770482

SEQ ID NO: 770486 - protein, 142 aa, Homo sapiens
MNGFSTEEDSREGPPAAPAAAAPGYGQSCCLIEDGERCVRPAGNASFSKRVQKSISQKKLKLDIDKSVDLFQLQVNTLRRYKRHYKLQTRPGFNKAQLAETVSRHFRNIPVNEKETLAYFIYMVKSNKSRLDQKSEGGKQLE

SEQ ID NO: 770487 - protein, 118 aa, Homo sapiens
ATEDPGVAMGRAPPVVTGIVKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADR

SEQ ID NO: 770488 - protein, 99 aa, Homo sapiens
WRLLWEVLLAGTLPLGVCKELSSYLDLLTASSPGHQERPGLEDGKEHTSQRILGGGFLQAVNLQPRLPASYGSNHFGSHRRLHIAIHREGEEMEKAKTF

SEQ ID NO: 770489 - protein, 90 aa, Homo sapiens
STSLPFSHPHPTAGSQESHSPSPLIPVSHNCPVNPQMQARFHLPQAPSFCFGITRGQAALQAPKFTLSYSWKSPAPGLTEPGEGISSHHS

SEQ ID NO: 770490 - protein, 101 aa, Homo sapiens
QTLPHHLRSQAPTYIGRIISATHHLQHHSCHRLLYVEFFPCLHLTLLSHCRDLSPATVLPLPSDGLLPGCIAVTQQILTPRQNSQEMPTEDADVIWFTDGP

SEQ ID NO: 770491 - protein, 366 aa, Homo sapiens
MAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 770492 - protein, 858 aa, Homo sapiens
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEKAAEDSGGGDDKKSKTCLML

SEQ ID NO: 770493 - protein, 350 aa, Homo sapiens
MLHILHGDMGASRPALKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKLLKIQEVVMTKSPKHV

SEQ ID NO: 770494 - protein, 805 aa, Homo sapiens
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKLLKIQEVVMTKSPKHV

SEQ ID NO: 770495 - protein, 85 aa, Homo sapiens
TTNTLSPTFYDFITHQINLIPITIKQSRNELDMYQRGEAGGGWRLPEGALSCGVAALRVDFGISVLQKLNIPISTQARRWKPRSA

SEQ ID NO: 770496 - protein, 91 aa, Homo sapiens
HQPPEWLGLQQCMRAPVAPHPQQHVVFGVLDFRHSNSQLMRHPLMELFHPSNLLQMPNDCRMVDAEFFSNFSCSFKRISFDDCSQLVVINF

SEQ ID NO: 770497 - protein, 575 aa, Homo sapiens
AAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 770498 - protein, 478 aa, Homo sapiens
TFAWGYADLSCRLGTYESDKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 770499 - protein, 575 aa, Homo sapiens; identical to SEQ ID NO: 770497

SEQ ID NO: 770500 - protein, 575 aa, Homo sapiens; identical to SEQ ID NO: 770497

SEQ ID NO: 770501 - protein, 264 aa, Homo sapiens
AAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGGNSELMSIKRPLQVAQETITKVQRYKQKEEQTL

SEQ ID NO: 770502 - protein, 281 aa, Homo sapiens
MEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFVNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 770503 - protein, 281 aa, Homo sapiens; identical to SEQ ID NO: 770502

SEQ ID NO: 770504 - protein, 575 aa, Homo sapiens; identical to SEQ ID NO: 770497

SEQ ID NO: 770505 - protein, 290 aa, Homo sapiens
AAVEAVNVFHHLFYEGQVDIYNINDPLKETATIGFINNFGQIPKQLFKKPHPPKRVRSRLNGDNAGISVLPGSTSDKIFFHHLDNLRPSLTPVKELKEPVGQIVCTDKGILAVEQNKAMTVYECLSEWGQILCAICPNPKLVITGGTSTVVCVWEMGTSKEKAKTVTLKQALLGHTDTVTCATASLAYHIIVSGSRDRTCIIWDLNKLSFLTQLRGHRAPVSALCINELTGDIVSCAGTYIHVWSINGNPIVSVNTFTGRSQQIICCCMSEMNEWDTQNVIAVSWGSSER

SEQ ID NO: 770506 - protein, 129 aa, Homo sapiens
MILDYLQQTQTAHLLFTPCKRPRESLEGLFFFSVLFYQSSKYCNFHSKWSQWGPISCPPDPLLQPIQQGKTQLCFLEGSHRGIKTAQPSLAPRRVPEPRARTWGMRTPKAGTGTARSPAAPSCLFTALS

SEQ ID NO: 770507 - protein, 43 aa, Homo sapiens
MAARAVFLALSAQLLQARLMKEESPVVSWRLEPEDGTALCFIF

SEQ ID NO: 770508 - protein, 139 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 770509 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 770510 - protein, 139 aa, Homo sapiens; identical to SEQ ID NO: 770508

SEQ ID NO: 770511 - protein, 117 aa, Homo sapiens; identical to SEQ ID NO: 770509

SEQ ID NO: 770512 - protein, 118 aa, Homo sapiens
MNLSRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 770513 - protein, 182 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQVGI

SEQ ID NO: 770514 - protein, 1743 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATDPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 770515 - protein, 1743 aa, Homo sapiens; identical to SEQ ID NO: 770514

SEQ ID NO: 770516 - protein, 81 aa, Homo sapiens [sequence omitted]

SEQ ID NO: 770517 - protein, 233 aa, Homo sapiens
KQAVPAVYGSGCKQAKPHSSRWRRSCCSRWGLPSRPLGEAPRPRQQVESSSWPEIDFSEKLCGAPAAGLPGAEEPLNPAPADLTAHSLGPHPPRTPEPSPTSSPRDQAKRVVSEEPAEKGKARPAEKDAKPVEAETSGMGDLPWAPPEAQAPSTAGAGDVAEHQVAPARFLQGAWRQAAGWLCRETGAAPGSAQAGPPETAHAADPQPRGPQAPPRLPPSLSPERVHPGQPAA

SEQ ID NO: 770518 - protein, 30 aa, Homo sapiens
MAPASKNAKEGSRSHGRRRWRKDKAKGERA

SEQ ID NO: 770519 - protein, 86 aa, Homo sapiens
MAKLTLLTGLLLVLTAEIGSAYQLTCYFTNWAQNQPGLGCFKPDDIDPCLCTHLIYAFAGMQNNEITTIEWDDMTLYQAFNGLKNK

SEQ ID NO: 770520 - protein, 123 aa, Homo sapiens
QRIPCRLSTLQASLPLSTTQAPAKGFLPTNQFFIFSHPLPESPPYPNSVSLLTSSNSYYRFVVVVVLRQSLSLSPRLEHSGTIPAHCNLHLRGSSDFPTSASRVAGITGMSYHAQPVVVYKQG

SEQ ID NO: 770521 - protein, 501 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770522 - protein, 219 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMPARDTIQGTTPDSECKPSPRSGMNFSGKHSG

SEQ ID NO: 770523 - protein, 219 aa, Homo sapiens; identical to SEQ ID NO: 770522

SEQ ID NO: 770524 - protein, 501 aa, Homo sapiens; identical to SEQ ID NO: 770521

SEQ ID NO: 770525 - protein, 483 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPIHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770526 - protein, 501 aa, Homo sapiens; identical to SEQ ID NO: 770521

SEQ ID NO: 770527 - protein, 322 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRKNMKTQVGML

SEQ ID NO: 770528 - protein, 350 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVHYLGG

SEQ ID NO: 770529 - protein, 448 aa, Homo sapiens
METILEQQRRYHEEKERLMDVMAKEMLTKKSTLRDQINSDHRTRAMQDICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770530 - protein, 448 aa, Homo sapiens; identical to SEQ ID NO: 770529

SEQ ID NO: 770531 - protein, 457 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVS

SEQ ID NO: 770532 - protein, 436 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFANLTIRLTAL

SEQ ID NO: 770533 - protein, 314 aa, Homo sapiens [sequence omitted]

SEQ ID NO: 770534 - protein, 276 aa, Homo sapiens
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGG

SEQ ID NO: 770535 - protein, 155 aa, Homo sapiens
METILEQQRRYHEEKERLMDVMAKEMLTKKSTLRDQINSDHRTRAMQDRYMEVSGNLRDLYDDKDGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770536 - protein, 501 aa, Homo sapiens; identical to SEQ ID NO: 770521

SEQ ID NO: 770537 - protein, 501 aa, Homo sapiens; identical to SEQ ID NO: 770521

SEQ ID NO: 770538 - protein, 501 aa, Homo sapiens; identical to SEQ ID NO: 770521

SEQ ID NO: 770539 - protein, 501 aa, Homo sapiens; identical to SEQ ID NO: 770521

SEQ ID NO: 770540 - protein, 501 aa, Homo sapiens; identical to SEQ ID NO: 770521

SEQ ID NO: 770541 - protein, 487 aa, Homo sapiens
FSTPERKLTALCHRLFFQLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770542 - protein, 448 aa, Homo sapiens; identical to SEQ ID NO: 770529

SEQ ID NO: 770543 - protein, 314 aa, Homo sapiens [sequence omitted]

SEQ ID NO: 770544 - protein, 338 aa, Homo sapiens [sequence omitted]

SEQ ID NO: 770545 - protein, 204 aa, Homo sapiens
KNLILGSKGSAKVTGKQEISLLILHYFFLTFHLWTCSKEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 770546 - protein, 67 aa, Homo sapiens [sequence omitted]

SEQ ID NO: 770547 - protein, 82 aa, Homo sapiens
IAHTKVQVRSQRQRGVGGNLKLLLQALVTVWENTSYSIPRVGELGLSVCSVWRTSTTHTNQPSSGRLYHHRLLSEIVTALLW

SEQ ID NO: 770548 - protein, 116 aa, Homo sapiens
VLVVVVPRAQVSFGWDGGWGMEWLGWGIGRLGWGMGWVPQHLLFSGLCFTSTWEGAGDGWCRVRQSLQLASWSWLCSGFLGLLNIKYQLYIPQAPFPPPLIGSLSALCRGQFNRVL

SEQ ID NO: 770549 - protein, 120 aa, Homo sapiens
LSPKVTLRNPGSSGRKERPEAGTGSWLGRTRNQVINTLADHHHRGTDFGGSPWLHIIIAFPTSYKVVITLWIVYLWVSLLKTIFWSRNGHDGSTDVQQRAWRSNRRRQVQGRGPTSTRPR

SEQ ID NO: 770550 - protein, 117 aa, Homo sapiens
LSPKVTLRNPGSSGRKERPEAGTGSWLGRTRNQVINTLADHHHRGTDFGGSPWLHIIIAFPTSYKVVITLWIVYLWVSILTFCRGILVITNKNKLYKTIHISGLHYEYVVLPKKSGK

SEQ ID NO: 770551 - protein, 122 aa, Homo sapiens
RQLTPLPPSAPPSADDNIKTTAERLRGPLPPSADDNLKTPSERQLTPLPPSAPPSAPPSADDNLKTRAECLLHPLPPSADDNLKTPSERQLTPLPPSAPPSADDNIKTPAERLRGPLPPSAD

SEQ ID NO: 770552 - protein, 398 aa, Homo sapiens
LSPKVTLRNPGSSGRKERPEAGTGSWLGRTRNQVINTLADHHHRGTDFGGSPWLHIIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHCITDNSLSLKTPLECLLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSAD

SEQ ID NO: 770553 - protein, 524 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGLPSGTPALNAKGTEAPAVVTEEEDDDEETAPPVIAPRPDHTKSIYTRSVIDPVPAPVGDSHVDGAAKSLDKQKKKPKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 770554 - protein, 518 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGLPSGTPALNAKGTEAPAVVTEEEDDDEETAPPVIAPRPDHTKSIYTRSVIDPVPAPVGDSHVDGAAKSLDKQKKKPKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKEPFSRDPLKSARKD

SEQ ID NO: 770555 - protein, 524 aa, Homo sapiens; identical to SEQ ID NO: 770553

SEQ ID NO: 770556 - protein, 428 aa, Homo sapiens
MPEQWARLLQTSNITKLEQKKNPQAVLDVLKFYDSNTVKQKYLSFTPPEKDGLPSGTPALNAKGTEAPAVVTEEEDDDEETAPPVIAPRPDHTKSIYTRSVIDPVPAPVGDSHVDGAAKSLDKQKKKPKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETACMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 770557 - protein, 919 aa, Homo sapiens [sequence omitted]

SEQ ID NO: 770558 - protein, 872 aa, Homo sapiens [sequence omitted]

SEQ ID NO: 770559 - protein, 478 aa, Homo sapiens
MTAPWRRLRSLVWEYWAGLLVCAFWIPDSRGMPHVIRIGGIFEYADGPNAQVMNAEEHAFRFSANIINRNRTLLPNTTLTYDIQRIHFHDSFEATKKACDQLALGVVAIFGPSQGSCTNAVQSICNALEVPHIQLRWKHHPLDNKDTFYVNLYPDYASLSHAILDLVQYLKWRSATVVYDDSTGLIRLQELIMAPSRYNIRLKIRQLPIDSDDSRPLLKEMKRGREFRIIFDCSHTMAAQILKQAMAMGMMTEYYHFIFTTLDLYALDLEPYRYSGVNLTGFRILNVDNPHVSAIVEKWSMERLQAAPRAESGLLDGVMMTDAALLYDAVHIVSVCYQRAPQMTVNSLQCHRHKAWRFGGRFMNFIKEAQWEGLTGRIVFNKTSGLRTDFDLDIISLKEDGLEKVGVWSPADGLNITEVAKGRGPNVTDSLTNRSLIVTTVLFPGKSLSHKSPQLWWVLWPHLESPAGAGSLYTCRIL

SEQ ID NO: 770560 - protein, 521 aa, Homo sapiens
MTAPWRRLRSLVWEYWAGLLVCAFWIPDSRGMPHVIRIGGIFEYADGPNAQVMNAEEHAFRFSANIINRNRTLLPNTTLTYDIQRIHFHDSFEATKKACDQLALGVVAIFGPSQGSCTNAVQSICNALEVPHIQLRWKHHPLDNKDTFYVNLYPDYASLSHAILDLVQYLKWRSATVVYDDSTGLIRLQELIMAPSRYNIRLKIRQLPIDSDDSRPLLKEMKRGREFRIIFDCSHTMAAQILKQAMAMGMMTEYYHFIFTTLDLYALDLEPYRYSGVNLTGFRILNVDNPHVSAIVEKWSMERLQAAPRAESGLLDGVMMTDAALLYDAVHIVSVCYQRAPQMTVNSLQCHRHKAWRFGGRFMNFIKEAQWEGLTGRIVFNKTSGLRTDFDLDIISLKEDGLEKVGVWSPADGLNITEVAKGRGPNVTDSLTNRSLIVTTVLVRACSPCRKDCPTWGWGGRSGWRVPSIPPTQKMEAAGRWRLLESAGSSQRAAGAQQRCSLPRAEAAAFLCLTPTHSPSP

SEQ ID NO: 770561 - protein, 156 aa, Homo sapiens
SLAKWQNPVSTKNTKISWAWWRAPAIPATREAKAGESLEPGKRRLQWAEIVPLHSTLGKSETESQKQKKKTQASASPGPVLAWGIPSVTNHDSEAGLACAPPEGASCTDDLLISAPPESSGRRRATGRPFYRRGNRDTGKVAICNPARFLSCFSVF

SEQ ID NO: 770562 - protein, 53 aa, Homo sapiens
PYIPLQMLQLWKLSEPAEHPLVRAMVISDAFRAGIHEGSSEDVVTEEAQDEGD

SEQ ID NO: 770563 - protein, 60 aa, Homo sapiens
MGSSCTWPPRPLTETSLSPQILGTLTSVVFMQLSSCHRGKTAACGLPTAWSLALQFLLEH

SEQ ID NO: 770564 - protein, 429 aa, Homo sapiens
STAPKPVVILVALCLPFACCAFRPVCVFLLLFCFALLVLWFFWFGLCRLQLQSNLFASLDETLLARAEALAAVDIAVSQGKSHPFKPDATYHTMNSVPCTSTSTVPLAHHHHHHHHHQALEPGDLLDHISSPSLALMAGAGGAGAAAGGGGAHDGPGGGGGPGGGGGPGGGGPGGGGGGGPGGGGGGPGGGLLGGSAHPHPHMHSLGHLSHPAAAAAMNMPSGLPHPGLVAAAAHHGAAAAAAAAAAGQVAAASAAAAVVGAAGLASICDSDTDPRELEAFAERFKQRRIKLGVTQADVGSALANLKIPGVGSLSQSTICRFESLTLSHNNMIALKPILQAWLEEAEGAQREKMNKPELFNGGEKKRKRTSIAAPEKRSLEAYFAVQPRPSSEKIAAIAEKLDLKKNVVRVWFCNQRQKQKRMKFSATY

SEQ ID NO: 770565 - protein, 498 aa, Homo sapiens
AGLELSEKRDREAGARRSARSEGAPGSSRSSSSSPRRGRRQPPRPPRLQPPKGGRVSRRTHFPADFRSVCGYTCQAATMMSMNSKQPHFAMHPTLPEHKYPSLHSSSEAIRRACLPTPPLQSNLFASLDETLLARAEALAAVDIAVSQGKSHPFKPDATYHTMNSVPCTSTSTVPLAHHHHHHHHHQALEPGDLLDHISSPSLALMAGAGGAGAAAGGGGAHDGPGGGGGPGGGGGPGGGGPGGGGGGGPGGGGGGPGGGLLGGSAHPHPHMHSLGHLSHPAAAAAMNMPSGLPHPGLVAAAAHHGAAAAAAAAAAGQVAAASAAAAVVGAAGLASICDSDTDPRELEAFAERFKQRRIKLGVTQADVGSALANLKIPGVGSLSQSTICRFESLTLSHNNMIALKPILQAWLEEAEGAQREKMNKPELFNGGEKKRKRTSIAAPEKRSLEAYFAVQPRPSSEKIAAIAEKLDLKKNVVRVWFCNQRQKQKRMKFSATY

SEQ ID NO: 770566 - protein, 163 aa, Homo sapiens
AGLELSEKRDREAGARRSARSEGAPGSSRSSSSSPRRGRRQPPRPPRLQPPKGGRVSRRTHFPADFRSVCGYTCQAATMMSMNSKQPHFAMHPTLPEHKYPSLHSSSEAIRRACLPTPPVSAPRPRPRPARPPLPVSETLHVGGWCVQVPVRGTAGRGCRAVP

SEQ ID NO: 770567 - protein, 161 aa, Homo sapiens
MVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLRLV

SEQ ID NO: 770568 - protein, 276 aa, Homo sapiens
VNILKTKICSNIYHIKSPNLVEEFKQRTQTALGRVFIFLLYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLRLV

SEQ ID NO: 770569 - protein, 349 aa, Homo sapiens
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLRLV

SEQ ID NO: 770570 - protein, 494 aa, Homo sapiens
RLNGAQGRGGGSVLLGGFSIQVPGVPGPWSSALGGATCVRQRDSGDWPAMPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 770571 - protein, 433 aa, Homo sapiens
RLNGAQGRGGGSVLLGGFSIQVPGVPGPWSSALGGATCVRQRDSGDWPAMPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPGMRINLVNRSWCYK

SEQ ID NO: 770572 - protein, 486 aa, Homo sapiens
RLNGAQGRGGGSVLLGGFSIQVPGVPGPWSSALGGATCVRQRDSGDWPAMPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPVIKKKVHFSGESKENIMRSENSESQLTSKSKCKDLKKRLHAAQLRAQALSDIEKNYQLKSRQILGMR

SEQ ID NO: 770573 - protein, 258 aa, Homo sapiens [sequence omitted]

SEQ ID NO: 770574 - protein, 497 aa, Homo sapiens
RLNGAQGRGGGSVLLGGFSIQVPGVPGPWSSALGGATCVRQRDSGDWPAMPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMKYDEDKIPSLRPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPVIKKKVHFSGESKENIMRSENSESQLTSKSKCKDLKKRLHAAQLRAQALSDIEKNYQLKSRQILGMR

SEQ ID NO: 770575 - protein, 282 aa, Homo sapiens
MNRMSYNDQISDFSLEDMRFICSGDMGCANNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 770576 - protein, 203 aa, Homo sapiens
MQSDYNTEYFLPQDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 770577 - protein, 104 aa, Homo sapiens
MTPFITGHLHLKGTEAHLYQNLYLLHITFPAFIASASSSNWEFIGCLISTWHSALCLLKPLILRRYKSGPMTIGFPGPTIYPITRNSQPDRTVEELTEDSVEES

SEQ ID NO: 770578 - protein, 89 aa, Homo sapiens
VSRELLLPTLRPCASPSFSLSCKEQRWRGSDSHNFRLAWRRLSESLGPQHRDTGRLPRVPMWATYQTEETGLEFKTLTDSPSHANSISL

SEQ ID NO: 770579 - protein, 86 aa, Homo sapiens
FRNGHVTQSKPEMQKLLLGLSEKRLTLNSSKLGGCEARVAVAILLPSDDSLRMEFTQREWRQQMKCKKPGQDIHVCTLVKCYLKPL

SEQ ID NO: 770580 - protein, 95 aa, Homo sapiens
TTSGDEEQRGQAQGAGGQMVVTGSHSGAQAGVRYHDHNSLQPQPPGLKDGSQMAALMFTRRCCVTGWEVMNYVMLHVGDMNYVMLRVGDMNYGRQ

SEQ ID NO: 770581 - protein, 86 aa, Homo sapiens
LDSWTHESWTWKKQHHKLDADSEHIQPSAELCPSPEICCQLASAVTEAPKGHSTVLSNQLLQDGEEHGQVKIEWASYLFHFEKHQD

SEQ ID NO: 770582 - protein, 501 aa, Homo sapiens
IQTGMQKEMEQDAKRFGQAAWATAIPRLEKLQLMLARETLQLMRAKELCLNHKRAEIQGKMEDLPEQEKNTNVVDELEIQFYEIQLELYEVKFEILKNEEILLTTQLDSLKRLIKEKQDEVVYYDPCENPEELKVIDCVVGLQDDKNLEVKELRRQCQQLESKRGRICAKRASLRSRKDQCKENHRFRLQQAEESIRYSRQHHSIQMKRDKIKEEEQKKKEWINQERQKTLQRLRSFKDKRLAQSVRNTSGSEPVAPNLPSDLSQQMCLPASHAVSVIHPSSRKTRGVPLSEAGNVKSPKCQNCHGNIPVQVFVPVGDQTHSKSSEELSLPPPPPPPPPPPPPPPPPPPPLRALSSSSQAATHQNLGFRAPVKDDQPRPLVCESPAERPRDSLESFSCPGSMDEVLASLRHGRAPLRKVEVPAVRPPHASINEHILAAIRQGVKLKKVHPDLGPNPSSKPTSNRRTSDLERSIKAALQRIKRVSADSEEDSDEQDPGQWDG

SEQ ID NO: 770583 - protein, 199 aa, Homo sapiens
IQTGMQKEMEQDAKRFGQAAWATAIPRLEKLQLMLARETLQLMRAKELCLNHKRAEIQGKMEDLPEQEKNTNVVDELEIQFYEIQLELYEVKFEILKNEEILLTTQLDSLKRLIKEKQDEVVYYDPCENPEELKVIDCVVGLQDDKNLEVKELRRQCQQLESKRGRICAKRASLRSRKVICIIPPGSVQRKSSVQIATG

SEQ ID NO: 770584 - protein, 106 aa, Homo sapiens
MCGCSKHYRDHMPGAETVLIGGMRLALRYTCVVWTGPMAMSHGASAGRSEKLQGQNRAASHICLQGGCDMSPLDRSPCCKCCRRDVLHGASHASAEAGTKVHQRAG

SEQ ID NO: 770585 - protein, 187 aa, Homo sapiens
EITSDFPTKPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 770586 - protein, 415 aa, Homo sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 770587 - protein, 415 aa, Homo sapiens; identical to SEQ ID NO: 770586

SEQ ID NO: 770588 - protein, 415 aa, Homo sapiens; identical to SEQ ID NO: 770586

SEQ ID NO: 770589 - protein, 196 aa, Homo sapiens
PRTLRYNTINTPKHTTRQPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 770590 - protein, 415 aa, Homo sapiens; identical to SEQ ID NO: 770586

SEQ ID NO: 770591 - protein, 105 aa, Homo sapiens
MLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 770592 - protein, 190 aa, Homo sapiens
AASGPGDSSGGALGHPCLGKRSYWLPSPDFVSPGPQPWPCPCLWALDLAQSPSTTHREHLERRTLLDAPSAPRPERRARAQSRPRPWDRTPWALLSTSRVGQGAMSLPLTPRDGQHPLPTRTQLGANTVRAPDPASRQPLTFLLILFLLFLLLVGAMFLLPASGGPCCSHARIPRTPYLVLSYVNGLPPV

SEQ ID NO: 770593 - protein, 124 aa, Homo sapiens
AASGPGDSSGGALGHPCLGKRSYWLPSPDFVSPGPQPWPCPCLWALDLAQSPSTTHREHLERRTLLDAPSAPRPERRARGSRHLSLPTGHAGVWPRPPETLSTSPKTLPAPEASGPPILHPGSL

SEQ ID NO: 770594 - protein, 404 aa, Homo sapiens [sequence omitted]

SEQ ID NO: 770595 - protein, 344 aa, Homo sapiens
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSTGQDLEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 770596 - protein, 276 aa, Homo sapiens
MHRLPRVRRGEHEALQVDLRGAAERVEALLAFGEGLAQRSEPRAWAALEQILRALGAYRDSIFRRLWQLQAQLVSYSLVFEEANTLDQDLEVEGDSDWPGPGGVWGPWAPSSLPTSTELEWDPAGDIGGLGPLGQKTARTLGVPCELCGHRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 770597 - protein, 39 aa, Homo sapiens
PPESRSLESWLQPRKGEWTVQHSRRRTGLESPTQDKCHL

SEQ ID NO: 770598 - protein, 116 aa, Homo sapiens
SHSVPRLECSDTYLAHCNLCLLGSRDSPALASPGAGITGMRHHAWLIFVFLVEPGFHPVGQADLELLTSGDLPTLASQSARITGVSHCTWPHSQFLNYYQRCPTFMPHPHPYEILI

SEQ ID NO: 770599 - protein, 42 aa, Homo sapiens
MGLEDIIFLDLQKEHDLELELGKRGNLRQMDGINVADALMLI

SEQ ID NO: 770600 - protein, 87 aa, Homo sapiens
HTGERPYECSECGKFFPYSSSLRKHQRVHTGSRPYECSECGKSFTQNSGLIKHRRVHTGEKPYECTECGKSFSHNSSLIKHQRIHSR

SEQ ID NO: 770601 - protein, 211 aa, Homo sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 770602 - protein, 211 aa, Homo sapiens; identical to SEQ ID NO: 770601

SEQ ID NO: 770603 - protein, 211 aa, Homo sapiens; identical to SEQ ID NO: 770601

SEQ ID NO: 770604 - protein, 211 aa, Homo sapiens; identical to SEQ ID NO: 770601

SEQ ID NO: 770605 - protein, 225 aa, Homo sapiens
GLHPVRASQLLCLPNQAWAMACAPPPASLPPCSLISDCCASNQRDSVGVGPSEPGARYNLVVRRFLSPSEKRSIRVGVTRFSRCRPSPLSLTGKGNSLTPWASQVRQCFALLRLAQGARTQLTCAHCLALPSEMNPVLQMEMQKSPVVCVAHAGSCRPELFLFGHLGSSILTITSPLCENLGISCSYGGAKQLKQPAMLSVHLEDNCYGELPRPRMDFYNRKVNF

SEQ ID NO: 770606 - protein, 161 aa, Homo sapiens
SVSQRVATPASRSGTGGKRAPPGIWWAKRAAPYVGGQRQKLAWPGSCSPILRPPPPSPRHPGLLDRLARGLLPAAFPPWRLQSPPGQRKQTSPSRKPVPQPPLGKDQPAEHPGPSAPALSFWLRVQEGWHETNRDPAVPEPASRTAETTQSPLLGALTWPS

SEQ ID NO: 770607 - protein, 117 aa, Homo sapiens
MKPSLEHHLGVSGATFSELGPGGTRGPQEPSKLREGLPRKPWDWHPQCRQSAPGGLAKRPRWPKSTMPTVCPRRVPRPCLVAPPGLPEGVGSCSLNPGRGHGGPHCQLLSSRVSRWA

SEQ ID NO: 770608 - protein, 117 aa, Homo sapiens; identical to SEQ ID NO: 770607

SEQ ID NO: 770609 - protein, 268 aa, Homo sapiens
MGASSEKGLKSSESQLKLKQILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTHLQVSH

SEQ ID NO: 770610 - protein, 175 aa, Homo sapiens
TTIKRQKILSEELQQNRRWNSREVPDISIRARLGGWTSPLKVTPLQPHHEGRSLSHIFTFDEEATCTDEGEPLVQTNKKCNAKDSFYKSSTQKAYEDVPWDKMLPPKLVPEETTLEKTADPISQCFTLKRYKGVPAITQMVGELWDRFQTRSFLAPVKPINFVSSSSRSKYIPLY

SEQ ID NO: 770611 - protein, 363 aa, Homo sapiens
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 770612 - protein, 147 aa, Homo sapiens
SVSHITLQRSQNLEPVYLKWQLYWVFSSCISLLSFFFFETEFCFMLSQAVGATWCESQTHLQTSDLPKYLRITEHPATTPVLNFLLFSGRRRMFTPMLGHGWISTHPDLQVVLRPPRASQQCCRLQSVSHMCPRRIVQAILLPQPPE

SEQ ID NO: 770613 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 770614 - protein, 408 aa, Homo sapiens
VCIERPTTSTTSLLFPAMNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 770615 - protein, 372 aa, Homo sapiens; identical to SEQ ID NO: 770613

SEQ ID NO: 770616 - protein, 389 aa, Homo sapiens
MPTVYLCSEQIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 770617 - protein, 372 aa, Homo sapiens; identical to SEQ ID NO: 770613

SEQ ID NO: 770618 - protein, 114 aa, Homo sapiens
MIVAGTYKHILMPRTGSLDSHQAPATCPTLGHAGRRVGTRKASLLPCWKLLESAVLLLCVFSDDLQHFLAWPHDAGKGSEPKTQAPRATGVGGSHSLERPHLLRTRTGRTTGGR

SEQ ID NO: 770619 - protein, 112 aa, Homo sapiens
PLVLFVCLFFGFCLFADGQWGGARVEGLLCAYIAIVCTRPSPLLLGEWEHANNLNKVFCCHLVKDPLPQDIYDWGLWVKEVKKWPHPISITESQNPWGFELSGWRKTSVCFQ

SEQ ID NO: 770620 - protein, 75 aa, Homo sapiens
GGSWAAAQKATLICKLGQQRPFIPPQGSHTLGGTVKSDSCPVVFKLGSSKPWGISAPGTPEVCYCCSEAFQHFLK

SEQ ID NO: 770621 - protein, 955 aa, Homo sapiens
EFRAGRTEPLAAATPAPAPAPARPAMTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 770622 - protein, 353 aa, Homo sapiens
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 770623 - protein, 837 aa, Homo sapiens
EFRAGRTEPLAAATPAPAPAPARPAMTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 770624 - protein, 837 aa, Homo sapiens; identical to SEQ ID NO: 770623

SEQ ID NO: 770625 - protein, 837 aa, Homo sapiens; identical to SEQ ID NO: 770623

SEQ ID NO: 770626 - protein, 773 aa, Homo sapiens
MPSTSFPVPSKFPLGPAAAVFGRGETLGPAPRAGGTMKSAEERTLWLCILQRQPRPAAPHGALHPAGPVPQPSDLHTGHHPAGGSPLGVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 770627 - protein, 368 aa, Homo sapiens
MEHRKLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 770628 - protein, 82 aa, Homo sapiens
TGADTTEVLVWTCGSLGSWRDSHSIFPASRPAPGTCTLAVRDVLVPCYGRGRSLWRPQLSAEAARHWLTTLMDQGGTEEEIK

SEQ ID NO: 770629 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 770630 - protein, 50 aa, Homo sapiens
MYNSQGENMALLLQKTEGVLVCICTLKLLTVKRQIGIAILQAPLGINFAF

SEQ ID NO: 770631 - protein, 825 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 770632 - protein, 716 aa, Homo sapiens; identical to SEQ ID NO: 770629

SEQ ID NO: 770633 - protein, 353 aa, Homo sapiens; identical to SEQ ID NO: 770622

SEQ ID NO: 770634 - protein, 693 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPGMLFTRGHLRPGLRRWWEPVPSRWSRTHLCTVTGTGLMGCGTEQRLCVARVCIRLWVFV

SEQ ID NO: 770635 - protein, 77 aa, Homo sapiens
WRDSHSIFPASRPAPGTCTLAVRDVLVPCYGRGRSLWRPQLSAEAARHWLTTLMDQGGTEEEMWVPGEMPCHRRERH

SEQ ID NO: 770636 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 770637 - protein, 155 aa, Homo sapiens; identical to SEQ ID NO: 770636

SEQ ID NO: 770638 - protein, 50 aa, Homo sapiens
LEARSLKSEPPGRVKVSAGLYFFWRRFCSLFSQAFRGHWNSLVCNHITPI

SEQ ID NO: 770639 - protein, 187 aa, Homo sapiens
MEWKLERTAPRRVRTEEEMLWVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKDHFSGSMKKRFEQED

SEQ ID NO: 770640 - protein, 130 aa, Homo sapiens
MGTHEAVRASRSVTFQAHRVLALGFFVARDSPATFIGQWRTDLGDSEVLRELARETLGLCTRSAPQDKGLGGEVPRGRLRPVGLCAGAGEPRDGARGCGDPLERYLDRQDPRCRSSTTHCPPPSRVRTLS

SEQ ID NO: 770641 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 770642 - protein, 95 aa, Homo sapiens
LLKKSPVLQYLNYLAQILIAMSPLSNNSLFLEYSKNPLREFLHKGLHVSLSTDDPMQFHYTKESRSALQPGRQSKTPSKKKKRYFERKRPQVFRG

SEQ ID NO: 770643 - protein, 261 aa, Homo sapiens
MWMLSKELSSLTDSMEYRTLWYGKGLTFSFHGYTNLLSLTAVLDHVMCQSSLIAKIYRMSTSRCTWGPVASQLPRILTSIEEDYDKRVLLSITTEILKSVVAHFDAGELITYRELVSRQMSNDLTEQAATFGLILDDVSLTHLTFGKEFTEAVEAKQVAQREAESTRFVAEKAEQQKKAAIISAEGDSKAAELIANSLATAGNSLIELRKLEAVEDITFQLLYSGNISSLPAGQSMLLQLPLRGHPACTSAGQLGHSPDDS

SEQ ID NO: 770644 - protein, 248 aa, Homo sapiens
MGIHFSCIRGDLKKPSKKRVKREPYSTTMLQVTSLSPINEILRRYSLYTNQHWRHHGFWRKKIQPQEASEEPPAHKDRGGGERPVNARVVRVAPLRPGFALCGYAVQDISKEDTVYDICNEDAVDISDEDTVDISNEASVHDISNEAAVCDISNDAVNISNEAAVRDISNDAVDICNEAAVHDISNEDTIEDISYEDTVYDITNEDAVRYLCKKDATKEPENTGELIRNEESMTDDEDKEAQRGAPGE

SEQ ID NO: 770645 - protein, 76 aa, Homo sapiens
FGFYPSSSSQRNQGSLGIWLMPGDGECQLDLKGRLAACVWQVRQTQEPAWWGIPGYPGDTVSAELNNIRNGSPRNE

SEQ ID NO: 770646 - protein, 237 aa, Homo sapiens
PFPQQAKAGDSLHIFKEDKSPSDSVELNGVHTGRLDLDQIVFKMPNWGGGAKCGACEKTVYHAEEIQCNGRSFHKTCFHCMACRKALDSTTVAAHESEIYCKVCYGRRYGPKGIGYGQGAGCLSTDTGEHLGLQFQQSPKPARSVTTSNPSKFTAKFGESEKCPRCGKSVYAAEKVMGGGKPWHKTCFRCAICGKSLESTNVTDKDGELYCKVCYAKNFGPTGIGFGGLTQQVEKKE

SEQ ID NO: 770647 - protein, 193 aa, Homo sapiens
PFPQQAKAGDSLHIFKEDKSPSDSVELNGVHTGRLDLDQIVFKMPNWGGGAKCGACEKTVYHAEEIQCNGRSFHKTCFHCSPQSRHAQLPPATLPNSLRSLESPRSALDVASQSMLLRRLWEVASLGTRPVSAVPSVGRVWSPQMSLTKMGNFIAKFAMPKILAPRVLGLEALHNKWKRKNEEVRRFSDFLRA

SEQ ID NO: 770648 - protein, 179 aa, Homo sapiens
PFPQQAKAGDSLHIFKEDKSPSDSVELNGVHTGRLDLDQIVFKMPNWGGGAKCGACEKTVYHAEEIQCNGRSFHKTCFHCMACRKALDSTTVAAHESEIYCKVCYGRRYGPKGIGYGQGAGCLSTDTGEHLGLQFQQSPKPARSVTTSNPSKFTAKSPSAPFEQNIYFLEVWGGSFDKT

SEQ ID NO: 770649 - protein, 152 aa, Homo sapiens
PFPQQAKAGDSLHIFKEDKSPSDSVELNGVHTGRLDLDQIVFKMPNWGGGAKCGACEKTVYHAEEIQCNGRSFHKTCFHCMACRKALDSTTVAAHESEIYCKVCYGRRYGPKGIGYGQGAGCLSTDTGEHLGLQFQHPKPARSVTQHLNTRV

SEQ ID NO: 770650 - protein, 237 aa, Homo sapiens; identical to SEQ ID NO: 770646

SEQ ID NO: 770651 - protein, 237 aa, Homo sapiens; identical to SEQ ID NO: 770646

SEQ ID NO: 770652 - protein, 100 aa, Homo sapiens
GGPPKKNPPLLYFPKKKFHLGESEKCPRCGKSVYAAEKVMGGGKPWHKTCFRCAICGKSLESTNVTDKDGELYCKVCYAKNFGPTGIGFGGLTQQVEKKE

SEQ ID NO: 770653 - protein, 51 aa, Homo sapiens
MLAEQVELWWSQQPRRSALCFVVAVGLVAGCGRGRRGTAVNHQQPLQVNGG

SEQ ID NO: 770654 - protein, 33 aa, Homo sapiens
MGFRCVGRAGLQLLTASDPPASASRGAGIADGV

SEQ ID NO: 770655 - protein, 108 aa, Homo sapiens [sequence omitted]

SEQ ID NO: 770656 - protein, 109 aa, Homo sapiens
MERRGVGWKSWTAPGCRWPCIIHGICKTLHLLRCSFFSCQTDIIPSLLFYNTDLPTGVGRGAGEAEPLPGELRNNLGRTFGMSARTEARTAGSPGKVGNRAAGSLVPPW

SEQ ID NO: 770657 - protein, 97 aa, Homo sapiens
VWLLGAKIKQLVGKQSIIAGQGVCPGTRAGSIFTDEPTRRMFSGTSGTCQEVCSVSLWFGTDPCSSPLAHWCWCLAESALPSCEGQTEQMALTTGMP

SEQ ID NO: 770658 - protein, 76 aa, Homo sapiens
QNMSFSVGRSLAEDYGDGLSNKTAWISILVPAPGGLTSLQFRFFTCKIGIRILLEELNKLRSMEYLEQGTRWILEC

SEQ ID NO: 770659 - protein, 237 aa, Homo sapiens
MSRPAHPAGIGCERGRTKPTPRARAHQWKRPLVLIDVPPSANGDEGKLQRVAPASADKSRPAGLGLHSEPSPVPSAASSAGGSGGLSFRAASSLPVSPSLAVSMKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 770660 - protein, 237 aa, Homo sapiens; identical to SEQ ID NO: 770659

SEQ ID NO: 770661 - protein, 237 aa, Homo sapiens; identical to SEQ ID NO: 770659

SEQ ID NO: 770662 - protein, 237 aa, Homo sapiens; identical to SEQ ID NO: 770659

SEQ ID NO: 770663 - protein, 102 aa, Homo sapiens
MSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 770664 - protein, 237 aa, Homo sapiens; identical to SEQ ID NO: 770659

SEQ ID NO: 770665 - protein, 244 aa, Homo sapiens
MSRPAHPAGIGCERGRTKPTPRARAHQWKRPLVLIDVPPSANGDEGKLQRVAPASADKSRPAGLGLHSEPSPVPSAASSAGGSGGLSFRAASSLPVSPSLAVSMKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQVRPAPGSPPRRRTLPRSSGLSLGDP

SEQ ID NO: 770666 - protein, 237 aa, Homo sapiens; identical to SEQ ID NO: 770659

SEQ ID NO: 770667 - protein, 237 aa, Homo sapiens; identical to SEQ ID NO: 770659

SEQ ID NO: 770668 - protein, 244 aa, Homo sapiens; identical to SEQ ID NO: 770665

SEQ ID NO: 770669 - protein, 219 aa, Homo sapiens
MSRPAHPAGIGCERGRTKPTPRARAHQWKRPLVLIDVPPSANGDEGKLQRVAPASADKSRPAGLGLHSEPSPVPSAASSAGGSGGLSFRAASSLPVSPSLAVSMKAFSPVRSVRKNSLSDHSLGISRSSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 770670 - protein, 237 aa, Homo sapiens; identical to SEQ ID NO: 770659

SEQ ID NO: 770671 - protein, 237 aa, Homo sapiens; identical to SEQ ID NO: 770659

SEQ ID NO: 770672 - protein, 244 aa, Homo sapiens; identical to SEQ ID NO: 770665

SEQ ID NO: 770673 - protein, 244 aa, Homo sapiens; identical to SEQ ID NO: 770665

SEQ ID NO: 770674 - protein, 340 aa, Homo sapiens
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 770675 - protein, 151 aa, Homo sapiens
ESCFCARTVSARVSGSGRGWSLCRRLGDATISADLVTFVSPPWRPQHSSSRSSPRRPRSGTCPGRRRPSGGGGQRGPGGRAGRRWLGWQVTGPQPDLFPSSPGLQPGPTCRGFPRHPPATQTRPFCLGLLPVLTLSPPAPFAEEEGGFRTW

SEQ ID NO: 770676 - protein, 266 aa, Homo sapiens
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAVLPG

SEQ ID NO: 770677 - protein, 245 aa, Homo sapiens
MVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAVLPG

SEQ ID NO: 770678 - protein, 360 aa, Homo sapiens
METSALKQQEQPAATKIRNLPWVEKYRPQTLNDLISHQDILSTTETPIQGKTLIQIGKDPGLGPNNLLAFSFLTGVPPPKGGEPGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 770679 - protein, 340 aa, Homo sapiens; identical to SEQ ID NO: 770674

SEQ ID NO: 770680 - protein, 181 aa, Homo sapiens
MVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAVLPG

SEQ ID NO: 770681 - protein, 619 aa, Homo sapiens
MEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770682 - protein, 619 aa, Homo sapiens; identical to SEQ ID NO: 770681

SEQ ID NO: 770683 - protein, 619 aa, Homo sapiens; identical to SEQ ID NO: 770681

SEQ ID NO: 770684 - protein, 697 aa, Homo sapiens
EEERKHKCWGPVTSRQCQLPDLAHWLSPFLVPVALRTLGPTPFFNEQIREENERRMSEPGMLGRKDVWVPRETPFTKAMEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770685 - protein, 654 aa, Homo sapiens
LRPRGLGGPVAGRVVVQSHATQSQPVYAETPFTKAMEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770686 - protein, 477 aa, Homo sapiens
MEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLHLPPLSQGLLECQRLAQA

SEQ ID NO: 770687 - protein, 415 aa, Homo sapiens
MGRQTALKRWPRSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770688 - protein, 412 aa, Homo sapiens [sequence omitted]

SEQ ID NO: 770689 - protein, 681 aa, Homo sapiens
LRYSRVIPVPPRWRRQARAPRAQETASRGGGLRIVAGGSVAAGRRTLSLELRLEKETPFTKAMEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770690 - protein, 610 aa, Homo sapiens
GVSTSLIRETPFTKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADEKPPQFVCRECKETFSTMTLLRRHERSHPELRPFPCTQCGKSFSDRAGLRKHSRTHSSVRPYTCPHCPKAFLSASDLRKHERTHPVPMGTPTPLEPLVALLGMPEEGPA

SEQ ID NO: 770691 - protein, 537 aa, Homo sapiens
MEVEAAEARSPAPGYKRSGRRYKCLSCTKTFPNAPRAARHAATHGPADCSEEVAEVKPKPETEAKAEEASGEKVSGSAAKPRPYACPLCPKAYKTAPELRSHGRSHTGEKPFPCPECGRRFMQPVCLRVHLASHAGELPFRCAHCPKAYGALSKLKIHQRGHTGERPYACADCGKSFADPSVFRKHRRTHAGLRPYSCERCGKAYAELKDLRNHERSHTGERPFLCSECGKSFSRSSSLTCHQRIHAAQKPYRCPACGKGFTQLSSYQSHERTHSGEKPFLCPRCGRMFSDPSSFRRHQRAHEGVKPYHCEKCGKDFRQPADLAMHRRVHTGDRPFKCLQCDKTFVASWDLKRHALVHSGQRPFRCEECGRAFAERASLTKHSRVHSGERPFHCNACGKSFVVSSSLRKHERTHRSSEAAGVPPAQELVVGLALPVGVAGESSAAPAAGAGLGDPPAGLLGLPPESGGVMATQWQVVGMTVEHVECQDAGVREAPGPLEGAGEAGGEEADENPHRGLPVPPFAWLCSLDSRSLPLSN

SEQ ID NO: 770692 - protein, 332 aa, Homo sapiens [sequence omitted]

SEQ ID NO: 770693 - protein, 111 aa, Homo sapiens
GIYRHTITGREAEPLGEHIAGVQPHAVMGAGWTLCVKTFFLCLVLGSEIHGAHSQEGENENEVRKTGTTMTRRLSWTRQGSPELHPLSPLARPMLPYRASCRRSGFPPSSS

SEQ ID NO: 770694 - protein, 141 aa, Homo sapiens
SVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNI

SEQ ID NO: 770695 - protein, 40 aa, Homo sapiens
CGARSILIEEVIIGVFVLKDSPNGQNGVGGEFSSKEQSIQ

SEQ ID NO: 770696 - protein, 103 aa, Homo sapiens
CGILSGVWLEWSGYCPKLFCLAGLPLSSSLGWREQAFVGAFLVSFGISEFSFFNYISGIYKTERNQGTLHHVVPPVSRSLDSLSSLHLSESSCACFLYNIYTF

SEQ ID NO: 770697 - protein, 132 aa, Homo sapiens
GGNIFEGNCYGKDILSVHKEASIGQELSKFNPCGKVFTLTPDLAAHLGILNARQPYKCKECRKGFKYFASLDNHMGIHIGEKFCEFQECRRAITHSSHLKQCVTVHTGKKSKKTKKHGKSFTNFSQLSAHVK

SEQ ID NO: 770698 - protein, 96 aa, Homo sapiens
LFQVKELERDRSRLCRRGGGTGQGCQLLRPLVLSPGPRGHLCPCVPMLPGRTGLVPCQEAELGNFRSLCLPGLGQAGLGQLRAPVRVQGYTKQRAS

SEQ ID NO: 770699 - protein, 113 aa, Homo sapiens
MCGCSRVVIIQKFSVLLGCRFPVLCQESRLLLGLFCLCCWCSGCWVLQLQIWGTGSKKLTPCCSAGPEVPAGLYLSESSYISCLYSFRVLSCSGQEEGESVSTPSSQKQKFPR

SEQ ID NO: 770700 - protein, 135 aa, Homo sapiens
APGKSMEASVDVSAPKVEADVSLPSMQGDLKTTDLSIQPPSADLKVQAGQMDVKLPEGQVPEGAGLKEHLPKVEMPSLKMPKVDLKGPQVDIKGPKLDLKVSKAEVTAPDVEVSLPSVEVDVQAPRAKLDSAQLE

SEQ ID NO: 770701 - protein, 104 aa, Homo sapiens
QEPSEREESTVEGAPVNESCGAANRADLHTQHGDFPGPDSRTCPQRLAASRAPSVTKMQRSGRHCTTPGSGAVAQVGIQRCNLNSLQTPPPRFKQFSCLSLLSS

SEQ ID NO: 770702 - protein, 125 aa, Homo sapiens
TPPSVRPTPASHPQGSPSQPQMTLSFLAVAGAPVLRRGVPRPLRLSVACRAPRAPRSDLQRLRSDCLCLQHAGPSPAAPAPHLPGTCPASACMWIDPHGPWPTLVPGATQGHWRSQLFIDHNCGH

SEQ ID NO: 770703 - protein, 650 aa, Homo sapiens
MSPPGARTLCQPLLFPACWRARCSRLPPSALLPPLGPAPCPPGQPGQPGRHQGSCPMDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGCPSDLEEGLLASPYGLLAHLPGPRSTLTLFLSHEPWRVVPTSSLEVSRCCGWLSVSRPAWQWDNRQRVGLAEHHLQPQL

SEQ ID NO: 770704 - protein, 650 aa, Homo sapiens; identical to SEQ ID NO: 770703

SEQ ID NO: 770705 - protein, 650 aa, Homo sapiens; identical to SEQ ID NO: 770703

SEQ ID NO: 770706 - protein, 434 aa, Homo sapiens
MSPPGARTLCQPLLFPACWRARCSRLPPSALLPPLGPAPCPPGQPGQPGRHQGSCPMDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRCAGAAEMLRNPLGS

SEQ ID NO: 770707 - protein, 292 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 770708 - protein, 292 aa, Homo sapiens; identical to SEQ ID NO: 770707

SEQ ID NO: 770709 - protein, 292 aa, Homo sapiens; identical to SEQ ID NO: 770707

SEQ ID NO: 770710 - protein, 292 aa, Homo sapiens; identical to SEQ ID NO: 770707

SEQ ID NO: 770711 - protein, 292 aa, Homo sapiens; identical to SEQ ID NO: 770707

SEQ ID NO: 770712 - protein, 326 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTYKKEKVNNNTCVAWAKRHRRTDNTYPLHFYGNTREDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 770713 - protein, 238 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 770714 - protein, 322 aa, Homo sapiens
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKEVSFLECDHRPLGSNLLKAKEVVDGLLCGLRFVEHLFFIYLLFIFFEMKPCSVTQAGVQWCDLSSLQPPPPGFKLSASAS

SEQ ID NO: 770715 - protein, 128 aa, Homo sapiens
MVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 770716 - protein, 128 aa, Homo sapiens; identical to SEQ ID NO: 770715

SEQ ID NO: 770717 - protein, 84 aa, Homo sapiens
MPAALVENSQVICEVWASNLEEEMRKIREIVLSYSYIAMWTRISGVVVRPCGEGSLGRRKERYRFGGEARKRFRKERCICEDSV

SEQ ID NO: 770718 - protein, 292 aa, Homo sapiens; identical to SEQ ID NO: 770707

SEQ ID NO: 770719 - protein, 292 aa, Homo sapiens; identical to SEQ ID NO: 770707

SEQ ID NO: 770720 - protein, 292 aa, Homo sapiens; identical to SEQ ID NO: 770707

SEQ ID NO: 770721 - protein, 186 aa, Homo sapiens
MYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 770722 - protein, 186 aa, Homo sapiens; identical to SEQ ID NO: 770721

SEQ ID NO: 770723 - protein, 238 aa, Homo sapiens; identical to SEQ ID NO: 770713

SEQ ID NO: 770724 - protein, 35 aa, Homo sapiens
MSFPIHIYAFQSDKSCEGTTSMLDHILNIGLLHDV

SEQ ID NO: 770725 - protein, 116 aa, Homo sapiens
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 770726 - protein, 133 aa, Homo sapiens
VASESSTLFMEASIRPSWLPFVCSPDISLTPPLGPSVLSTFVDPSAETPSPPRALDIYSAVDDASHEKELIEALQEVLKKLKSKRVPIYEKKYGQVPMCDAGEQCAVRKGARIGKLCDCPRGTSCNSFLLKCL

SEQ ID NO: 770727 - protein, 169 aa, Homo sapiens
MESSRVRLLPLLGAALLLMLPLLGTRAQEDAELQPRALDIYSAVDDASHEKELVGIPLALDPLELSPCLFSVHASLLPPPPLLFPESGRGELSATPRHPLPSEERLELTGSWQSVERIPHPGPSEQQGPQRLRDPRSVPGTASAKFPPLDHSLCPRSPTAECVWVRGSL

SEQ ID NO: 770728 - protein, 116 aa, Homo sapiens; identical to SEQ ID NO: 770725

SEQ ID NO: 770729 - protein, 116 aa, Homo sapiens; identical to SEQ ID NO: 770725

SEQ ID NO: 770730 - protein, 116 aa, Homo sapiens; identical to SEQ ID NO: 770725

SEQ ID NO: 770731 - protein, 99 aa, Homo sapiens
MHGYMSKMGNPFLTQWQRRYFYLLPQPTRVAGRGRGPGKEPMRGVREPGFRVAGPAGIFTCTTIPGLQQSLLTMEEIQTEEETQIRRRKCLLLQIRGGK

SEQ ID NO: 770732 - protein, 501 aa, Homo sapiens
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 770733 - protein, 388 aa, Homo sapiens
MENQLWHNTVRCCNQYQESPHDAEDILLLLLGLIVLVNIGINVATMMWHGLQNALDKMIDWATQKRGPGFLPGGGGQPALPVSQVPTSRLGRVLSESGPALQCGAVGPPGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 770734 - protein, 486 aa, Homo sapiens
FGTRVTHIAAKRCHNYTECLSLIRRTRIPTWRRRTTCPSRIPSTHVAAGAGFIRERACPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 770735 - protein, 480 aa, Homo sapiens
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFAAATAVVAVAAATTSSGRRTTDKSPIATQSSVTHIAAKRCHNYTECLSLIRRTRIPTWRRRTTCPSRIPSTHVAAGAGFIRERACPPMWGCGATRWYPGQSATTSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 770736 - protein, 316 aa, Homo sapiens
SGSGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRP

SEQ ID NO: 770737 - protein, 171 aa, Homo sapiens
SGSGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEPLAASINPLNDHWTLRDGAALLLSHIFWTHGDLVSGLYQHILLSLQKILADPVRP

SEQ ID NO: 770738 - protein, 341 aa, Homo sapiens
SGSGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSVPSAVSSLTDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRP

SEQ ID NO: 770739 - protein, 332 aa, Homo sapiens
SGSGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVEDFNRALRWSSVEAVCGYGSQEALPMRPAREGELYFPEDREVNLVELALATNIPKGCAETAVRVHVSYLDGKGNLAPQGSDDLLKYYHQVTRAVLGDDPQLMKVALQDLQTNSKIGALLPYFVYVVSGVKSVSHDLEQLHRLLQVARSLFRNPHLCLGPYVRCLVGSVLYCVLEPLAASINPLNDHWTLRDGAALLLSHIFWTHGDLVSGLYQHILLSLQKILADPVRP

SEQ ID NO: 770740 - protein, 171 aa, Homo sapiens
SGSGNECELVSGRRRHRPRRRRLGSSLRHAGVFSSTGAMSEREERRFVEIPRESVRLMAESTGLELSDEVAALLAEDVCYRLREATQNSSQFMKHTKRRKLTVENHVRARRAGGLWRSLGSLSGPPPGGGPEDPSLSVTLADIYRELYAFFGDSLATRFATGQPATTVRGR

SEQ ID NO: 770741 - protein, 67 aa, Homo sapiens
ADCNLLPKLHIVKVVAKKYRNFDIPKEMTGIWRYLTNAYSRDEFTNTCPSDKEVEIAYSDVAKRLTK

SEQ ID NO: 770742 - protein, 92 aa, Homo sapiens
TCTLTDVLQTAASTGRSINGYTLPLTLLPVASAGRMEKLSVEALKRLTGEFKGKYYPLKSMTEKEQQQLIDDHFLFDKPVSPLVLASGMARD

SEQ ID NO: 770743 - protein, 102 aa, Homo sapiens
MQSGLACQGVTGTVSPEILCEDTQVLFRSGPVSGRGKTAPTSCRHTVPAPPTGLAHTSNKYLISAHHLPLCQVPGLIMSQAEVVCAVFPQCERVLRRLLTLI

SEQ ID NO: 770744 - protein, 91 aa, Homo sapiens
LIPEMRGSVTKTLPSTCGLSHATKHLVIPTSQRAACVTHLFISISMVFGLKIKPSKFQQTTLGDHHLSVVISIPSRIYLLTADSNANLLFL

SEQ ID NO: 770745 - protein, 223 aa, Homo sapiens
MDSRVSSPEKQDKENFVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVSVVQF

SEQ ID NO: 770746 - protein, 467 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770747 - protein, 467 aa, Homo sapiens; identical to SEQ ID NO: 770746

SEQ ID NO: 770748 - protein, 621 aa, Homo sapiens
GAQRANEGRRGGGWGGDAEFPSAGALAYPATGQSLSVYGEKGEMEKSGRRWLASAAPPLGRLRRRESGAEQGGLSVRATRVSLVRSALDCAPRSGVRRPGSCFCRCRRRIPVARRARLPQACSQHRTEPSGGRGWSARPAWERKAADSPERATVMEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770749 - protein, 502 aa, Homo sapiens
RGSGDPLSLRLPLPTPPGRPHSPCPRPDSPERATVMEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770750 - protein, 450 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKRKYLGHIHVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770751 - protein, 224 aa, Homo sapiens
RYPRGLPTSPNIPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770752 - protein, 395 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLSGLCPLGAQEAAE

SEQ ID NO: 770753 - protein, 158 aa, Homo sapiens
GAQRANEGRRGGGWGGDAEFPSAGALAYPATGQSLSVYGEKGEMEKSGRRWLASAAPPLGRLRRRESGAEQGGLSVRATRVSLVRSALDCAPRSGVRRPGSCFCRCRRRIPVARRARLPQACSQHRTEPSGGRGWSARPAWERQGRRCNLLTAKKPGE

SEQ ID NO: 770754 - protein, 467 aa, Homo sapiens; identical to SEQ ID NO: 770746

SEQ ID NO: 770755 - protein, 243 aa, Homo sapiens
DIKPSNIVFMSGWITFFECRKSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 770756 - protein, 269 aa, Homo sapiens [sequence omitted]

SEQ ID NO: 770757 - protein, 122 aa, Homo sapiens
RFAKQIRQQYVMKMNTQEAKQKADIKIKDRTLFVDQNLSMSVQDNESNREPSDPSQCDANNMKHSDLNNLKLSVPDNRQLLEQESIMKAQPQHESLGIIWNLLQNLFKIGLQKKKLYIRNLK

SEQ ID NO: 770758 - protein, 147 aa, Homo sapiens
QQRSLMDWSFTEHFKPKVLLQVLQEAHKQYRCVDSYYHTQDNSLLLVFHNPMNRQRLHCEYWNIALHSNVGFRNYLELVAKSIQDWITKEEAIYQESKMNEKIIRTRAELELKSSANAKLTSASKIFSIKESKSNKGISKTEISDQE

SEQ ID NO: 770759 - protein, 110 aa, Homo sapiens
RFAKQIRQQYVMKMNTQEAKQKADIKIKDRTLFVDQNLSMSVQDNESNREPSDPSQCDANNMKHSDLNNLKLSVPDNRQLLEQESIMKAQPQHESLGKLKCVCVCVCVCV

SEQ ID NO: 770760 - protein, 164 aa, Homo sapiens
WTEAGAKALFLSPGSLQTSLQNQSQEATYPEQHKTEFLLLPPRVECNGAILTHWRILMGIARVHAAVRPGRVKAHSAIASVSVVSEGTDMAEPEEIAYLDSLGSPVESLHRVTVQVEDIPVHIIPCAESLGGEHIEARERGGIQHERLEQRCKPLWHHYRSIST

SEQ ID NO: 770761 - protein, 268 aa, Homo sapiens
GSRAAMSLQEEAEPTPSPPSPNRESLALALTAAHSRSGSEGRTPERASSPGLNKPLLATGDSPAPSVGDLAACAPSPTSAAHMPCSLGPLPREDPLTSPSRAQGGLGGQLPASPSCRDPPGPQQLLACSPAWAPLEEADGVQATTDTGAEDSPVAPPSLTTSPCDPKEALAGCLLQGEGSPLEDPSSWPPGSVSAVTCTHSGDTPKDSTLRIPEDSRKEKLWESPGRATSPPLAGAVSPSVAVRATGLSSTPTGDEAQAGRGLPGPDP

SEQ ID NO: 770762 - protein, 118 aa, Homo sapiens
SGRGGQGLWRGKRRASDGANGGLSAVLCGGGTQRPLRRGGRKLPLRVGGLRGKGKRRDGVDSRRETLGLSGRSARHTRSRGCGPGLARPAPAAPQPLRWPPPPQPRQGLTSSRRCFFY

SEQ ID NO: 770763 - protein, 187 aa, Homo sapiens
AGGAGRGCGAASGGPATARMADSQLFCVAEERSGHCAVVDGNFLYVWGGYVSIEDNEVYLPNDEIWTYDIDSGLWRMHLMEGELPASMSGSCGACINGKLYIFGGYDDKGYSNRLYFVNLRTRDETYIWEKITDFEGQPPTPRDKLSCWVYKDRLIYFGGYGCRRHSELQDCFDVHDASWEEQIFWG

SEQ ID NO: 770764 - protein, 631 aa, Homo sapiens
GAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECRMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLG

SEQ ID NO: 770765 - protein, 84 aa, Homo sapiens
HCTRHFFILLDSESCECIAITSKFWEKPTARMSEGPRSRFLLTASTQGQQLPHRRMDMWTVDVERMWWLSTLFSGYFWTENPSI

SEQ ID NO: 770766 - protein, 82 aa, Homo sapiens
PLRLARRLRALRSTGSASSRHGFLPSSPAVSWGPALVGGRGSDASLPSRLNHLEAAAPRMCTLTTKAEPAPPRPWAGGRPLP

SEQ ID NO: 770767 - protein, 82 aa, Homo sapiens; identical to SEQ ID NO: 770766

SEQ ID NO: 770768 - protein, 82 aa, Homo sapiens; identical to SEQ ID NO: 770766

SEQ ID NO: 770769 - protein, 82 aa, Homo sapiens; identical to SEQ ID NO: 770766

SEQ ID NO: 770770 - protein, 82 aa, Homo sapiens; identical to SEQ ID NO: 770766

SEQ ID NO: 770771 - protein, 70 aa, Homo sapiens
TASIAGCVRKRRPQFPRWRCGSQSKVGLSKPTRSFEPGGGSCHWHRFGVVAPVYYFWGGLNQVLAPSIPT

SEQ ID NO: 770772 - protein, 145 aa, Homo sapiens
MNTSLSWFEQLDVLLNATDGNVVRNKQWLYPLGVSTELIGLCICFFCSSGCIFLGSPPQNSTAVTPAVLWEESEIMQKELKLLQYQLSQHQELLLKQLAEGRQAQVGSWKIPRGAPFLTWSPASFSSMPRVLSKRTYSFGAPKCS

SEQ ID NO: 770773 - protein, 118 aa, Homo sapiens
MNTSLSWFEQLDVLLNATDGNVVRNKQWLYPLGVSTELIGLCICFFCSSGCIFLGSPPQNSTAVTPAVLWEESEIMQKELKLLQYQLSQHQELLLKQLAEGRQAQVGSWKDLHSCCPI

SEQ ID NO: 770774 - protein, 120 aa, Homo sapiens
QGAPKGSAFLLEQCLEELRKELQGLQSQVWEQTQAQAQAQMQTGPGECSTTNGLPQELQTEIALLSLLQCCREESEIMQKELKLLQYQLSQHQELLLKQLAEGRQAQVGSWKDLHSCCPI

SEQ ID NO: 770775 - protein, 422 aa, Homo sapiens
AESAGNLKAWTLRDRQTGANVRGRRRRRRRWSPPGRAGRGARSRRREVPLEPAQPAALAQSGRTKSSERRRGERLVHAPCAAAGPGRQRGAGASRAPRSPWSNFGCPAAAAFPSRPGRGVAANLCAFLPPRWEPALREGLSRRLMLPALRLPSLGEPPPERRGSAAAPRARRALLRGRGTKQQPRARARGMERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 770776 - protein, 85 aa, Homo sapiens
RIPYGRLSPPELYFPAGCTQDHMIRNCNCGHYLYPLPRGEKYCNNRDFPDWAHCYSDLQMSVAQRETCIGMCKESCNDTQYNLPV

SEQ ID NO: 770777 - protein, 694 aa, Homo sapiens
LEPSHHQLSMLLHINPAYLFKLLHGFPPWIMPTDGNLGDKNFQMGKPGHREGATMHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 770778 - protein, 698 aa, Homo sapiens
ASPPLNLLPPSRSRRARRVSQCHQHSAAAASLARTAASATADSAHPPCPRSAARAGATMHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 770779 - protein, 694 aa, Homo sapiens; identical to SEQ ID NO: 770777

SEQ ID NO: 770780 - protein, 176 aa, Homo sapiens
KGIVKLNIYFLLQGDIGALVPLLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 770781 - protein, 136 aa, Homo sapiens
RYWHFWQGRWLREESGDQAGVQWHDLGLLQPLCSRFKLFSRLSLPSSWDYRCPPPRLANFCIFSRDKVLPCWPGWFKLLTSGDLPASASLSAGIAGVSHRALPRILTVKCCCFNLEILRTELDEFVLIFTSVFFSF

SEQ ID NO: 770782 - protein, 127 aa, Homo sapiens
VGARVGGSRAAPGSPPPRLRLPKRGRSAAPGCSTWRAEHRAGSPRGRAVGGADCGKKARGVAAARSGAGAPPLAAALTCRLVSPRRRGSLRFGWRGAGRAGSQRVCGGRGRDPTTGSPPGAALLPLP

SEQ ID NO: 770783 - protein, 102 aa, Homo sapiens
LPPISNPTSPAASLFTIPRIRPLLSTPTAAAPKEATSSLTEIVQQPLPPFTFACGHSPHMARECVLLKPARSRSSSTQNAPLAPTAPRVKAQTLQMTQSPTR

SEQ ID NO: 770784 - protein, 93 aa, Homo sapiens
QGTMQEMEEGPQEPVPQPAWSSEPQKRDTQGFARADGSTAGCAGHHFITLALSYLICKKGNKWYLPARVVLRLTVAGIASLVNTQEPLSSLWL

SEQ ID NO: 770785 - protein, 80 aa, Homo sapiens
EPFICCVTCAPSYGHVRRRIEDGQRACFTCDQSLTLLCDAIPYGVYQEQNSQFNRWFPQYLKRCGAKLETVQDDYTLLLI

SEQ ID NO: 770786 - protein, 241 aa, Homo sapiens
EEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWI

SEQ ID NO: 770787 - protein, 1564 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 770788 - protein, 1476 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTVHKRWLRFLPF

SEQ ID NO: 770789 - protein, 143 aa, Homo sapiens
GQCQSGTERLSVNESQEPRVFVEYWHSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 770790 - protein, 98 aa, Homo sapiens
VRGKIRFSHIFHTKRGCGASTKGGSDSSLSEPGPGRSGRGFLFRVLRAALPLQLLLLLLIGLACLVPMSEEDYSCALSNNFARSFHPMLRYTNGPPPL

SEQ ID NO: 770791 - protein, 1468 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTKCW

SEQ ID NO: 770792 - protein, 1495 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTQTAPRGSFSARWLQSHSGRGGGLGEAVDDC

SEQ ID NO: 770793 - protein, 1295 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKVAAPCLSHGGQTESHRVNDRADGTSSSSCSYTAAEKGSNKNE

SEQ ID NO: 770794 - protein, 603 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDFKRNWLCSRDFQFFL

SEQ ID NO: 770795 - protein, 67 aa, Homo sapiens
KDYSKQCASTVQQQEDRTNELLKAATNKDIADDEVATWIQDCNVCSGATLFSPHALLRLPKFSFWSV

SEQ ID NO: 770796 - protein, 189 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLERNRYRARF

SEQ ID NO: 770797 - protein, 828 aa, Homo sapiens
MYSALPSEDEEGQDDKDFYLRGAVGLSGDHSALESQIRQLGKALDDSRFSETAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 770798 - protein, 183 aa, Homo sapiens [sequence omitted]

SEQ ID NO: 770799 - protein, 956 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIGRYCQEVFGRVEDKQ

SEQ ID NO: 770800 - protein, 1564 aa, Homo sapiens; identical to SEQ ID NO: 770787

SEQ ID NO: 770801 - protein, 1152 aa, Homo sapiens
SKALLQLWQRYKDYSKQCASTVQQQEDRTNELLKAATNKDIADDEVATWIQDCNDLLKGLGTVKDSLFVLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGRKEPLQFASLKESQRELILPWKHDSYPESFASFFHAGKLYLSEHLDMNVIIKCKIWCGR

SEQ ID NO: 770802 - protein, 388 aa, Homo sapiens
LPPPARAPPPPSMDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770803 - protein, 388 aa, Homo sapiens; identical to SEQ ID NO: 770802

SEQ ID NO: 770804 - protein, 531 aa, Homo sapiens
MTGSRNWRATRDMCRYRHNYPVRTCPCPGTQNPPASCSSQAECPRFYWKAGLACCARATVLGRTLPGAQPGIDSEPCPSPLAGDRGHPPTFLSFSTPSPCKHGHSASLVMHTCGVRDTAHTAPHPHASPVSCRLSSAITLHTPESRKPLCCLQGAEEGTCQAWPGWRNGEGGSLGLGGSCCPLNGPHLQSEEPGGLLGYWASLEVCRCASPKDTEEPQGSLCLMDPCCPLSLALQDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770805 - protein, 79 aa, Homo sapiens
RIQRPLNSSPRLRLHLGGGRGGCGGRGGRGLRGRRGRRREGRGRRGRGRGVGGAAGGAAQLVPVQNDRVQKLASHEGHV

SEQ ID NO: 770806 - protein, 388 aa, Homo sapiens; identical to SEQ ID NO: 770802

SEQ ID NO: 770807 - protein, 392 aa, Homo sapiens
MTGARVRCTMWTLELTNSHPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770808 - protein, 377 aa, Homo sapiens
MVTSPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770809 - protein, 312 aa, Homo sapiens
SGVDLEDPVGVRVKLPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770810 - protein, 388 aa, Homo sapiens; identical to SEQ ID NO: 770802

SEQ ID NO: 770811 - protein, 313 aa, Homo sapiens
LPPPARAPPPPSMDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPLTRGSMWPHNGMV

SEQ ID NO: 770812 - protein, 317 aa, Homo sapiens
MTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770813 - protein, 317 aa, Homo sapiens; identical to SEQ ID NO: 770812

SEQ ID NO: 770814 - protein, 317 aa, Homo sapiens; identical to SEQ ID NO: 770812

SEQ ID NO: 770815 - protein, 395 aa, Homo sapiens
EEEYRSVLVLFRARARMSSYYGPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770816 - protein, 387 aa, Homo sapiens
MTRGAFDKSLVLVRPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770817 - protein, 317 aa, Homo sapiens; identical to SEQ ID NO: 770812

SEQ ID NO: 770818 - protein, 429 aa, Homo sapiens
LPPPARAPPPPSMDDPDCDSTWEEDEEDAEDAEDEDCEDGEAAGARDADAGDEDEAARQGARGLAAGPNASVRSLHDIEQGFHDMLGDAHEGDLCVTRIQGSEDNPGNHGWDREDRAMWGGRRLKSHEFFYERNEIQGSRAARGAVVIRGTFSYQQSWERDQTIEAPLRGLVHSLHSSWLFPLRDPWSATGVAIAPHGSGGVEGVQKMVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQVGPVGQSIARVGAGWTRGPSHGAWSPRMRDPWRGARGMRQGATGKIGRSP

SEQ ID NO: 770819 - protein, 323 aa, Homo sapiens
RRPPARPPARPPPARPPARPPAARPPARPPARRPPARPPARPPPARPPARPPAARPPARPPARRPPARPPARPPPARPPARPPAARPPARPPARRPPARPPARPPPARPPARPPAARPPARPPARRPPARPPARPPPARPPARPPAARPPARPPARRPPARPPARPPPARPPARPPAARPPARPPARRPPARPPARPPPARPPARPPAARPPARPPARRPPARPPARPPPPAQAPARQDLQGTSQPRAHRRPQAPARQDLQGMSQPRRGRQQSCRTQRWSLLPSLGSLKERSARRRLGPPVPAAGAGASGAAAGSPQALLRDP

SEQ ID NO: 770820 - protein, 365 aa, Homo sapiens
GRSRCPGPGARGGTMSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 770821 - protein, 177 aa, Homo sapiens
GRSRCPGPGARGGTMSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGGKAWHGGDSGCHLLTESRSGERTQRRKEGGSLGQCWPEAIVGTQDPMRSPPYLWGRNQ

SEQ ID NO: 770822 - protein, 273 aa, Homo sapiens
HVCNSTSRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 770823 - protein, 343 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 770824 - protein, 284 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLLCPPHAVTPRTQFPSPDWTVSL

SEQ ID NO: 770825 - protein, 407 aa, Homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRRSLTLWPSLEYSGTISAHCNLRLPGSSDSRASASRAAGITGVSHCARPCMLFDPEFDLLAGVQLLPFEPPTGKALSRKD

SEQ ID NO: 770826 - protein, 665 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 770827 - protein, 665 aa, Homo sapiens; identical to SEQ ID NO: 770826

SEQ ID NO: 770828 - protein, 573 aa, Homo sapiens
MEAQVYGSSCYFGLFLSVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 770829 - protein, 544 aa, Homo sapiens
MHQTALTHLAIEALFSLIPPDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 770830 - protein, 586 aa, Homo sapiens
MQFSNRPPSSTGIASSTPCSLQTSPVKILPMKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 770831 - protein, 586 aa, Homo sapiens; identical to SEQ ID NO: 770830

SEQ ID NO: 770832 - protein, 506 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 770833 - protein, 267 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISSVVLARSYLKALEMESAD

SEQ ID NO: 770834 - protein, 568 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 770835 - protein, 586 aa, Homo sapiens; identical to SEQ ID NO: 770830

SEQ ID NO: 770836 - protein, 363 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKLWYQDTASLME

SEQ ID NO: 770837 - protein, 506 aa, Homo sapiens; identical to SEQ ID NO: 770832

SEQ ID NO: 770838 - protein, 286 aa, Homo sapiens
MRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 770839 - protein, 586 aa, Homo sapiens; identical to SEQ ID NO: 770830

SEQ ID NO: 770840 - protein, 79 aa, Homo sapiens
QQHFHVETLWQEDGLIMQLCLCSLQMPIHQNLKELLAVRAELQKRVEGLQREVATRAVSSSSERGSSPSHSATSVHTSV

SEQ ID NO: 770841 - protein, 204 aa, Homo sapiens
MVTARAPSWPKKSSKAFGARALSSFLNRNKDRGRARWLTPVIPAFWEVEADGLLEVMSSRPAWPTRWSLAPMLECSGVISADCNLRLPGSSDSPASASGVAGITAKISRRCMQEELNFRGHRLIFNTWQFTKQRRGVAMLPRLVSNSGAQAICLPRPFKVLRLQPEEERGNPGEKHLEFKLREEDTESQLRTQTGRRKIIFPSL

SEQ ID NO: 770842 - protein, 823 aa, Homo sapiens [sequence omitted]

SEQ ID NO: 770843 - protein, 641 aa, Homo sapiens
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSVTQEEDPVLTVITYMGLSVSLLCLLLAALTFLLCKAIQNTSTSLHLQLSLCLFLAHLLFLVAIDQTGHKVLCSIIAGTLHYLYLATFTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 770844 - protein, 763 aa, Homo sapiens
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATFTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 770845 - protein, 94 aa, Homo sapiens
EDPVLTVITYMGLSVSLLCLLLAALTFLLCKAIQNTSTSLHLQLSLCLFLAHLLFLVAIDQTGHKVLTAVFQRAPFLDAGHAGSWNDAAFDSLI

SEQ ID NO: 770846 - protein, 154 aa, Homo sapiens
MWFSLEKWVPESSKLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATFTWMLLEALYLFLTARNLTVVNYSSINRFMKKLMFPVGYPVNN

SEQ ID NO: 770847 - protein, 763 aa, Homo sapiens; identical to SEQ ID NO: 770844

SEQ ID NO: 770848 - protein, 776 aa, Homo sapiens
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATFTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVRSRIAPEHFTNRPT

SEQ ID NO: 770849 - protein, 1261 aa, Homo sapiens
GAPTVTSVEETKPRQGARPGRGSPGLVGAPARAEGPSDPRAAAAAAAASQQVRAASLSAPLPRIRDPPGHLSSAGAAVWPPASMRFGSKMMPMFLTVYLSNNEQHFTEVPVTPETICRDVVDLCKEPGESDCHLAEVWCGSVEIEFHHVGQDGLDLLTLCSACLGLPKCWITGVSHHDQPLVFKKERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 770850 - protein, 1217 aa, Homo sapiens
GAPTVTSVEETKPRQGARPGRGSPGLVGAPARAEGPSDPRAAAAAAAASQQVRAASLSAPLPRIRDPPGHLSSAGAAVWPPASMRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 770851 - protein, 181 aa, Homo sapiens
GAPTVTSVEETKPRQGARPGRGSPGLVGAPARAEGPSDPRAAAAAAAASQQVRAASLSAPLPRIRDPPGHLSSAGAAVWPPASMRFGSKMMPMFLTVYLSNNEQHFTEVPVTPETICRDVVDLCKEPGESDCHLAEVWCGSERPVADNERMFDVLQRFGSQRNEVRFFLRHERPPGRDIGR

SEQ ID NO: 770852 - protein, 1067 aa, Homo sapiens
MFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 770853 - protein, 773 aa, Homo sapiens
MPRMPSRPELLVKPALPDGSLVIQASEGPMKIQTLPNMRSGAASQTKGSKIHPVGPDWSPSNADLFPSQGSASVPQSTGNALDQVDDGEVPLREKEKKVRPFSMFDAVDQSNAPPSFGTLRKNQSSEDILRDAQVANKNVAKVPPPVPTKPKQINLPYFGQTNQPPSDIKPDGSSQQLSTVVPSMGTKPKPAGQQPRVLLSPSIPSVGQDQTLSPGSKQESPPAAAVRPFTPQPSKDTLLPPFRKPQTVAASSIYSMYTQQQAPGKNFQQAVQSALTKTHTRGPHFSSVYGKPVIAAAQNQQQHPENIYSNSQGKPGSPEPETEPVSSVQENHENERIPRPLSPTKLLPFLSNPYRNQSDADLEALRKKLSNAPRPLKKRSSITEPEGPNGPNIQKLLYQRTTIAAMETISVPSYPSKSASVTASSESPVEIQNPYLHVEPEKEVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 770854 - protein, 1217 aa, Homo sapiens; identical to SEQ ID NO: 770850

SEQ ID NO: 770855 - protein, 617 aa, Homo sapiens
GAPTVTSVEETKPRQGARPGRGSPGLVGAPARAEGPSDPRAAAAAAAASQQVRAASLSAPLPRIRDPPGHLSSAGAAVWPPASMRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVVSLVPESLSPEDVGNASTENSDMPAPSPGLDYEPEGVPDNSPNLQNNPEEPNPEAPHVLDVYLEEYPPYPPPPYPSGEPEGPGEDSVSMRPPEITGQVSLPPGKRTNLRKTGSERIAHGMRVKFNPLALLLDSSLEGEFDLVQRIIYEVDDPSLPNDEGITALHNAVCAGHTEIVKFLVQFGVNVNAADSDGWTPLHCAASCNNVQVCKFLVESGAAVFAMTYSDMQTAADKCEEMEEGYTQCSQFLYGVQEKMGIMNKGVIYALWDYEPQNDDELPMKEGDCMTIIHREDEDEIEWWWARLNDKEGYVPRNLLGLYPRIKPRQRSLA

SEQ ID NO: 770856 - protein, 1217 aa, Homo sapiens; identical to SEQ ID NO: 770850

SEQ ID NO: 770857 - protein, 498 aa, Homo sapiens
GAPTVTSVEETKPRQGARPGRGSPGLVGAPARAEGPSDPRAAAAAAAASQQVRAASLSAPLPRIRDPPGHLSSAGAAVWPPASMRFGSKMMPMFLTVYLSNNEQHFTEVPVTPETICRDVVDLCKEPGESDCHLAEVWCGSERPVADNERMFDVLQRFGSQRNEVRFFLRHERPPGRDIVSGPRSQDPSLKRNGVKVPGEYRRKENGVNSPRMDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVIQASEGPMKIQTLPNMRSGAASQTKGKKSCTA

SEQ ID NO: 770858 - protein, 160 aa, Homo sapiens
GNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAMISGRPQPKISWYKEEQLLSTGFKCKFLHDGQ

SEQ ID NO: 770859 - protein, 128 aa, Homo sapiens
KIWHPFTIKTLSKVGIQGTYLNIIKAIYDKPTTSIIMNEEKLQAFPLRTGTRQGCPISPPLFSIVLEVLARAIRQEKEIKGIQISKEKVKLSLFAVDIIYLENPKDDSRKLLELIEEFGKVSGYNIKV

SEQ ID NO: 770860 - protein, 240 aa, Homo sapiens
MALRPHHGPAVGGLLLEHSKLRSVSVDLNVDPSLQIDIPDALSERDKVKFTVHTKTTLPTFQIQSFLLQGNMRTLCDYMTLLLKQQTMLGLFISTWFLKKAPIWWAPQKESSRENIVERSVKGSSDPREECAKMKQELEAEYLAVFKKTVSSHEVFLQRLSSHPVLSKDRNFHVFLEYDQDLMLGGQNTKEMFGGFFKSVVNSADEVLFTGVKEVDDFFEQEKNFLINYYNRIKDSCVES

SEQ ID NO: 770861 - protein, 123 aa, Homo sapiens
LSYKIPIKYLRVFHPYHFELVKPTESGKADEATAKTQLYATVVRKSSFIPRYIGCNHMALEIFLRGVNEPLANNPNPIVVIARVVPNYKEFKVSQANRDLASVGLPITPLSFPIPSMMNFDVP

SEQ ID NO: 770862 - protein, 67 aa, Homo sapiens
RLRAEKLSGAVAQSDFVPPPGAFLHSLPRSRTNKDLQIRVQTPRVVGSVGGSEESLEGTQRVSRPSQ

SEQ ID NO: 770863 - protein, 105 aa, Homo sapiens
MEVSMAPSGFVDGNTFIQEIKSRCNLRPEENKLSSLILDILPFEVSRDDLTGNVLLGKCVNGSGVQRQDLDGNRYGQQLKLCVHESSLLREFKIRQDEALEVSVS

SEQ ID NO: 770864 - protein, 86 aa, Homo sapiens
KGHKSLPSWSLPSNKERQRVRNKQTKICELTQSVGGCQVLWEKRGACQGESRQEGILERPRKMVTFDLHIHQPPAQSICQRQTEEG

SEQ ID NO: 770865 - protein, 114 aa, Homo sapiens
LCRSERKDSSFLESGIKTASKLALSMAPKGNSVLHLPLWVCPDCRRTVEKEERHGLDQPVSQDFLLHSSLGGSQPEAGSGGRLALGAQTLPSDTACSCEACSERREISEADREP

SEQ ID NO: 770866 - protein, 107 aa, Homo sapiens
WLLLLFVVVETGFCYIAVLLYCLGWSCLEPLGENDPPTLASQSVGKTSMSHCAQAGESFLMPHIPAHHSANEVQVGLTIALRINVSLAPCSFPCAVSGCIFFFYPTL

SEQ ID NO: 770867 - protein, 103 aa, Homo sapiens [sequence omitted]

SEQ ID NO: 770868 - protein, 52 aa, Homo sapiens
MRSMEQILELLVLEEFLTILSQDIHSRVQKLQRASCEEAVTLLKYMYDFKRE

SEQ ID NO: 770869 - protein, 207 aa, Homo sapiens
MSAAAAAAAVDSGGWCIVLGTGGAEETSAISFCTVIFVLETPERKTGPDAPPGAIPPSPPPQPKAPVAPAFESEPLGSRRLLGEETLAAAGAGATRLRAGRRRGARYGEPSNEARAGAQRRRVLAEHGRGAAAAVAAGAQGPLHHWQPWSPSIFLPQGRRLDSAHVLGEEGAGTRASPEGGGTCARAEGATLSYPLPPQPALPHPAA

SEQ ID NO: 770870 - protein, 213 aa, Homo sapiens
MPTFSGQLRSRLSPLLPPRRRPLQSPPGRSARRQRQANVAFPSPPPGPPPPPASPELSVAQTSPPGPARPSPRAPQTLSNPLGSRRLLGEETLAAAGAGATRLRAGRRRGARYGEPSNEARAGAQRRRVLAEHGRGAAAAVAAGAQGPLHHWQPWSPSIFLPQGRRLDSAHVLGEEGAGTRASPEGGGTCARAEGATLSYPLPPQPALPHPAA

SEQ ID NO: 770871 - protein, 384 aa, Homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRIHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVHAASWLLCCALSALNPLLYTWRNEEFRRSVRSVLPGVGDAAAAAVAATAVPAVSQAQLGTRAAGQHW

SEQ ID NO: 770872 - protein, 69 aa, Homo sapiens
STLLYLTYLSDQQQNKVDGCGSSCCQSSCCKPCCCQSSCCVPVCCQSSCCKPCCCQSNCCVPVCCQCKI

SEQ ID NO: 770873 - protein, 179 aa, Homo sapiens
AAVAAPEAVAPAVGAVAPAVGVVALAVGAVAPAVGAVALAVGAAAPAVGDVAPDVMCLSAAASPCAPGCQPVPAPAVAPVGAPRGAVAPVGVPRGAVVLVAAPSPAVVSPVAAPQAVDHPAASPAAASPAAASPAAVSPCAASPAAASPVAASPTVVSLCAASVRSEALDPDLQVSPVW

SEQ ID NO: 770874 - protein, 162 aa, Homo sapiens
SCLPAWRSYSTPQDFKREIPPGLSHREESDFLRLFQSGPFGASLLEFAGGPLLTLFAWVSPAEAAKQQRLLPVLSSRSFDPVGHLSDASQSSPVSGVCRSKLEGCGARQEGKKSLSSWKLNCTDKGGKCQGVNNSVSVASSCPLPETEIQPICTFILRVAPL

SEQ ID NO: 770875 - protein, 162 aa, Homo sapiens; identical to SEQ ID NO: 770874

SEQ ID NO: 770876 - protein, 72 aa, Homo sapiens
CVLQPVGFFWLLWPTTPAAGLEACRTDTHSPEQPSTNDLQDWVDKYPSSLTLQHHEKSFSPVNGHSHLWVHD

SEQ ID NO: 770877 - protein, 411 aa, Homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 770878 - protein, 411 aa, Homo sapiens; identical to SEQ ID NO: 770877

SEQ ID NO: 770879 - protein, 397 aa, Homo sapiens
MGREPWPEDRDLGFPQLFCQGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 770880 - protein, 211 aa, Homo sapiens
MGREPWPEDRDLGFPQLFCQGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVAAPPLESPQCRSRKDPGPRGRYCGVVEKVE

SEQ ID NO: 770881 - protein, 123 aa, Homo sapiens
MRGPSGPPGLLYVPHLLLCLLCLLPPPLQYAAGQSQMPKDQPLWALLEQYCHTIMTLTNLSGSGLPLIMKGLAGRPLPIPSSHDGSQLGWHSGVQEGDDPSAFQLQGNWQKVVNILWLPWLQV

SEQ ID NO: 770882 - protein, 438 aa, Homo sapiens
MRGPSGPPGLLYVPHLLLCLLCLLPPPLQYAAGQSQMPKDQPLWALLEQYCHTIMTLTNLSGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 770883 - protein, 521 aa, Homo sapiens
LPSRAGWGGAGQGVTTVLGSRLQSLTPSHYWHEGSLRAPRPPLRPTPPPLPALPPPTAAPIRSRAEPDAQRPAPVGTSGAVLPHHHDPHQPLSHAGRALPLPLRTRLRDAMDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 770884 - protein, 397 aa, Homo sapiens; identical to SEQ ID NO: 770879

SEQ ID NO: 770885 - protein, 252 aa, Homo sapiens
LPSRAGWGGAGQGVTTVLGSRLQSLTPSHYWHEGSLRAPRPPLRPTPPPLPALPPPTAAPIRPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVAAPPLESPQCRSRKDPGPRGRYCGVVEKVE

SEQ ID NO: 770886 - protein, 107 aa, Homo sapiens
LACFNFLRYYKIKYYSYCLIHSIQRYFIIQTVDPTGTGHGGESIFGLGLYGDQASFFETENVPRIKHKKKGTMSMVNNDSDQHGSQFLITTGENLDYLDGTIQYLVR

SEQ ID NO: 770887 - protein, 31 aa, Homo sapiens
MGSEAQFPVLPAAAVFLRDFLGPSVFQVVDS

SEQ ID NO: 770888 - protein, 91 aa, Homo sapiens
MLSEGQVSLRSEELKGWNVSWWASAGSGVTASLEASFPNSLWEPPGDSGMSLPGAWVTVQDPRHTWVETLLSPSLGVTSILEPQLPHLGGY

SEQ ID NO: 770889 - protein, 133 aa, Homo sapiens
TEAAAAMLEEGKEPPGPAHPADALDLEGAELGVARRSGRADGARVGLVSLGTGSKNNYLKQEAQSPPTLAGITLDRTEEEPPSGTLLSAMDGTLLSAMDGTLLSAMDVSSPGPRGAESVPLKKPSAGPLSAPR

SEQ ID NO: 770890 - protein, 102 aa, Homo sapiens
MHTHAHSLSWAHAYPHTHSCTFPGNGITFQIDSDSNGSLLNTFMQAAIQGDPQQNINDEELPSWGPVESTLQSSLGFCGHRVHLWMFVAHSPCLVCSGSPGT

SEQ ID NO: 770891 - protein, 102 aa, Homo sapiens
MPRARSLIHPIPFHISLTVLLYICWAECHLCAPALPACTSHTEKAVASSSWRETPSQLPRHEQVCFGTTWETRSRRGKLFLICHRPALPQATSPYPSHVARA

SEQ ID NO: 770892 - protein, 256 aa, Homo sapiens
MPRAEPRATLGEQEKAGLPLGAWRLYLLRHFRKQTELRRSGSRDVTGALLVAAAVASEAVGSLRVAEGGPNTLLLQVLRSWPWCNKELKTMEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGGMQEKLARLNLELYGELEELPEDKRKTASDSNLDRLLSDLEELNSSIQKLHLADAQDVPNTSAS

SEQ ID NO: 770893 - protein, 274 aa, Homo sapiens
MPRAEPRATLGEQEKAGLPLGAWRLYLLRHFRKQTELRRSGSRDVTGALLVAAAVASEAVGSLRVAEGGPNTLLLQVLRSWPWCNKELKTMEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 770894 - protein, 274 aa, Homo sapiens; identical to SEQ ID NO: 770893

SEQ ID NO: 770895 - protein, 259 aa, Homo sapiens
MRIWWLLLAIEICTGNINSQDTCRQGHPGIPGNPGHNGLPGRDGRDGAKGDKGDAGEPGRPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDMPIKFDKILYNEFNHYDTAAGKFTCHIAGVYYFTYHITVFS

SEQ ID NO: 770896 - protein, 121 aa, Homo sapiens
MSEQRDTAMAAAGQRIRSVRETRSPAPGTQFGSPSPPCRAGSPGAGSGEKRTAAPPHRASFHPLWYMALPRSPTSRHTFTVSPGSRSPETVPAAPNHCSAAPTSATDSPSLLGETLQCLGC

SEQ ID NO: 770897 - protein, 121 aa, Homo sapiens; identical to SEQ ID NO: 770896

SEQ ID NO: 770898 - protein, 342 aa, Homo sapiens
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRPRGQPWVWASMESPSHTHGLSHLRGIFNWVLSYRRDSDIFVPYGRLEPHWGPSPPLPAKSRVAAWVVSNFQERQLRARLYRQLAPHLRVDVFGRANGRPLCASCLVPTVAQYRFYLSFENSQHRDYITEKFWRNALVAGTVPVVLGPPRATYEAFVPADAFVHVDDFGSARELAAFLTGMNESRYQRFFAWRDRLRVRLFTDWRERFCAICDRYPHLPRSQVYEDLEGWFQA

SEQ ID NO: 770899 - protein, 48 aa, Homo sapiens
METGRREQVIEDVGTENGHSSPYPRLLAFLHSLNESILMKQLHLPRIL

SEQ ID NO: 770900 - protein, 54 aa, Homo sapiens
MPLHSSLGDTAKKKTTKLDLYLTVSIQISSRGKIYHKITQKFLYLWCGTVFSKL

SEQ ID NO: 770901 - protein, 76 aa, Homo sapiens
ACGPRTQRDMVGCGVRAGTPHTARCTYTGAACRERGTRRDAGCRSGAHGAGFHGAARARVYVVGGGPGATVTQGPE

SEQ ID NO: 770902 - protein, 122 aa, Homo sapiens
MWTGALPGGLEAEGRGGGCHGPQGAVGRWEPSCCTPGTVRENPGDLGESWARVGIFDGEGSESRDVLWWWGASGQVPEDPGELMNTGLAGCQGRAEGAVVASRQGALPGLEGGVGLLECCSH

SEQ ID NO: 770903 - protein, 165 aa, Homo sapiens
STSQLPAAISPSVRGGVGPSGSPCSNSALPGPDGSLDLPTCWSRPSGGSEAAKPSPAPLHFQAPKRPPASASMEEQAWVPVAQPRRGQFPQMAQKALGGNNRGLLAERRTGGNRGKAHATSTLGTMPPRPGLPRAGCELAVLAVSRWEGPHWVPVVLSPASTSHL

SEQ ID NO: 770904 - protein, 341 aa, Homo sapiens
MRKNHACFVETPNLAGEGMSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGALYEYVFCPDVEFKRRFKEAFSKAAQQTKGSYMEVEDNRSQVETDDLILKPGVVHVIDVDRGEEKKGKDQSGEVLSSV

SEQ ID NO: 770905 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGALYEYVFCPDVEFKRRFKEAFSKAAQQTKGSYMEVEDNRSQVETDDLILKPGVVHVIDVDRGEEKKGKDQSGEVLSSV

SEQ ID NO: 770906 - protein, 59 aa, Homo sapiens
VSGARDTHASSIHFSALCCRFTAVQLFKRYKPVMWPKLFCRLCSLQESDARRPEGCMAL

SEQ ID NO: 770907 - protein, 168 aa, Homo sapiens
MAEPWGNELASAAARGDLEQLTSLLQNNVNVNAQNGFGRTALQVMKLGNPEIARRLLLRGANPDLKDRTGFAVIHDAARAGFLDTLQTLLEFQADVNIEDNEGNLPLHLAAKEGHLRVVEFLVKHTASNVGHRNHKGDTACDLARLYGRNEVVSLMQANGAGGATNLQ

SEQ ID NO: 770908 - protein, 189 aa, Homo sapiens
MRSEKREKKPAPSLRGNRSSNCFSEKSSKGGSEGKKQKRGRHASACRGERSRDRRSRGGSATKETVTGSGAAKEEAVLPGSAPGHSWLAAALSAAKGHRPGTARGGKVAPGAEAAERSPRRRPDWLPRNCGDSPYSELGLRFPGLSPSPEAPTKPGKEGKDSGGSSSMSAYSRKPVIWPGSMGGMRLLA

SEQ ID NO: 770909 - protein, 168 aa, Homo sapiens; identical to SEQ ID NO: 770907

SEQ ID NO: 770910 - protein, 168 aa, Homo sapiens; identical to SEQ ID NO: 770907

SEQ ID NO: 770911 - protein, 168 aa, Homo sapiens; identical to SEQ ID NO: 770907

SEQ ID NO: 770912 - protein, 168 aa, Homo sapiens; identical to SEQ ID NO: 770907

SEQ ID NO: 770913 - protein, 168 aa, Homo sapiens; identical to SEQ ID NO: 770907

SEQ ID NO: 770914 - protein, 176 aa, Homo sapiens
EEVALVPRLSQQPSRLGVVAVQHLQLHDKGNLYVPLQKAPKRFLGFQGPEQPHGLQPPKAAAQHGRALQVQLAAGVGAVAEEPSLLVAQGRARSVSSGSEARPRMVMRTGLSRQPRPAGSRISVADISELERGILRSRPEARPRSWQVRRLSRGRPASPGAGSGRWLSSPRKRLGL

SEQ ID NO: 770915 - protein, 105 aa, Homo sapiens [sequence omitted]

SEQ ID NO: 770916 - protein, 107 aa, Homo sapiens
MANVLAFKWQHYISKENVIKHAFAASWKRVLCKHGRSSSESNSLPTPQATKGMKSKDGQRFLAHHLSKRDEAQSFRLLCPALNLANRTSAFCSPSRTPAIPGKDYRQ

SEQ ID NO: 770917 - protein, 66 aa, Homo sapiens
AEQLAAVQRGRRAVTGAPCRACCAQASAVRAEVGRFLEVDEVVGGGRFVGRVFRLQAQQLRPRSAV

SEQ ID NO: 770918 - protein, 74 aa, Homo sapiens
HVPRWYRSCDCKHIRGHRVHHVHGSEQYSDYSYRPTPPNIPVSRYGQPFQLSRIVLESYVRYQHSDSSSIVLES

SEQ ID NO: 770919 - protein, 144 aa, Homo sapiens
MPGAPSYHRVSSYAVPSAWNAVPRPVCQVSSFLVRSQLEDASLAILPHLSRVWVQELGCAVPSGSTHSVWCSHSQLHLLLAWRTETESALLDAVSASAWCLVHSRRSRKSRAGGAPPPSPKEKTEANVLLGEAEAPRPAPGSPS

SEQ ID NO: 770920 - protein, 109 aa, Homo sapiens
APEFLDRWPLFDTLDSNLLTFFQLASVHSILTTAMVGFYMIPICVSTWSPQPGALSCLFLAFDVPPFPVINLSFPTAQQYMTDTRIKHPVRASSSVSPLVSIPRGLPLW

SEQ ID NO: 770921 - protein, 53 aa, Homo sapiens
MERRSRLKEQRCGNSKAWRPSKAASPLEGCSHRRRGWGWRGQGPREGLGSKVI

SEQ ID NO: 770922 - protein, 89 aa, Homo sapiens
YSGKCFQGPPGFGWSPWRGGSGAEFRDPSISQVSPSIFPSGTVSEQVCPGEVVSTVSEQVCPGEVVSTVCEQVWLLQVEVGICGHLGAH

SEQ ID NO: 770923 - protein, 235 aa, Homo sapiens
NGPPAMGAAAPAESADLGNFWKAGEPLLQGPDALAAPMSRSPSTPQTTPSPQGRQSPWPLRSLTQSHIQYFQWGRPVPSTHLIEVRPTQDPAKPQRVVSEGWRRPALPGETALGRDLSCAWEGCMKGGLCRAWNPGRTWSPVTIGIAPPERQESPWRSPGQRARPAGRPAAQELLDPCTRETLLGALSQCPKGSARFDGPLWFEVSDSKGGRRNLQPRPSAFKPLSKNGAVASFV

SEQ ID NO: 770924 - protein, 485 aa, Homo sapiens
MDPTALVEAIVEEVACPICMTFLREPMSIDCGHSFCHSCLSGLWEIPGESQNWGYTCPLCRAPVQPRNLRPNWQLANVVEKVRLLRLHPGMGLKGDLCERHGEKLKMFCKEDVLIMCEACSQSPEHEAHSVVPMEDVAWEYKWELHEALEHLKKEQEEAWKLEVGERKRTATWKIQVETRKQSIVWEFEKYQRLLEKKQPPHRQLGAEVAAALASLQREAAETMQKLELNHSELIQQSQVLWRMIAELKERSQRPVRWMLQDIQEVLNRSKSWSLQQPEPISLELKTDCRVLGLREILKTYAADVRLDPDTAYSRLIVSEDRKRVHYGDTNQKLPDNPERFYRYNIVLGSQCISSGRHYWEVEVGDRSEWGLGVCKQNVDRKEVVYLSPHYGFWVIRLRKGNEYRAGTDEYPILSLPVPPRRVGIFVDYEAHDISFYNVTDCGSHIFTFPRYPFPGRLLPYFSPCYSIGTNNTAPLAICSLDGED

SEQ ID NO: 770925 - protein, 98 aa, Homo sapiens
PPRPCYSTMTGHNEDTESAEGQAAVHLSHHTQVKLQLMLAHLLEKSLCQQHFRISYSEDNSFSEEGTVTAGGHLCFRPCGTPGTLTLGEDVVSGHTNA

SEQ ID NO: 770926 - protein, 165 aa, Homo sapiens
GKLHTCPTLHLAGRPFATGVHSRPQTSQLPAPRAPDHTAPAPGTPDQPPAPGAPDQPLRLEPQTTQPPEPRAPDQPLHPEPQPTQPPALGAPDHTAPAPGAPDQPLCPEPQDRRRLPCSWHTVVLGKEPVGHTAVCQAGAGAGAPGSPRGGEMELPPWSWAPTST

SEQ ID NO: 770927 - protein, 391 aa, Homo sapiens
MSELRLCCDLLVQQVDKTKEVTTTGVSNSEEGIDVGTLLKSTCNTFLKTLEECMQIANAAFTSELLYHTPPGSPQLAMLKSSKMKHPIIPIHNSLERQTELSTCENGSLNMEINGEEEILMKNKNSLYLKSAEIDCSISSEENTDDNITVQGEIMKEDRMENLKNHDNNLSQSGSDSSCSPECLWEEGKEVIPTFFSTMNTSFSDIELLEDSGIPTEAFLASCCAVVPVLDKLGPTVFAPVKMDLVENIKKVNQKYITNKEEFTTLQKIVLHEVEADVAQVRNSATEALLWLKRGLKFLKGFLTEVKNGEKDIQTALNNAYGKTLRQHHGWVVRGVFALALRATPSYEDFVAALTVKEGDHRKEAFSIGMQRDLSLYLPAMKKQMAILDAL

SEQ ID NO: 770928 - protein, 391 aa, Homo sapiens; identical to SEQ ID NO: 770927

SEQ ID NO: 770929 - protein, 391 aa, Homo sapiens; identical to SEQ ID NO: 770927

SEQ ID NO: 770930 - protein, 85 aa, Homo sapiens
QVASRRAVSRDEFPSPCPAHHCPALWALRLTERDLPHPGTLWIEATQRQSLDDQGGPTRSERQWRFCQGRPQRPSSEKKNVLASR

SEQ ID NO: 770931 - protein, 344 aa, Homo sapiens
KKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPTTSNPTDTRKITSGNSSNSPNAEVMAVQKKLDSIIDLTKEGLSNCNTESPVSPLESHSKAASNSKETTPLAQNAVQVPESFEHLPPLPEPPAPLPELVDKTRDTLPPQKPELKVKRVFRPNGIALTWNITKINPKCAPVESYHLFLCHENSNNKLIWKKIGEIKALPLPMACTLSQFLASNRYYFTVQSKDIFGRYGPFCDIKSIPGFSENLT

SEQ ID NO: 770932 - protein, 26 aa, Homo sapiens
MSIPDEMLHQNSSGLASSENGPARFA

SEQ ID NO: 770933 - protein, 26 aa, Homo sapiens
MSIPDEMLHQNSSGLASSENGPARFA

SEQ ID NO: 770934 - protein, 26 aa, Homo sapiens
MSIPDEMLHQNSSGLASSENGPARFA

SEQ ID NO: 770935 - protein, 26 aa, Homo sapiens
MSIPDEMLHQNSSGLASSENGPARFA

SEQ ID NO: 770936 - protein, 26 aa, Homo sapiens
MSIPDEMLHQNSSGLASSENGPARFA

SEQ ID NO: 770937 - protein, 375 aa, Homo sapiens
LHNPHCPHIPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770938 - protein, 253 aa, Homo sapiens
GRRGTRSPAGHRPCRPRSWEDADGSESVRGHVTAAIRAHGADARFPAVPPRWPRSLPVPASLSHQPEAAPAACAPGSTMTGTAAQPAAASPGTPASCPAAASLLLRPQPRSVPGRTKPPQSCWLAAAGRVSACVSCRPAAPQSAGMGQPGRARALGRSSRSCFRLLVLPLALTAKGRRAEQLRRGRVGVGSRFPWGFQAGVRGAAASWGAAPASGGPEPQEAGAPRRGYCGLRPAPPPPAPAPAATLSLFLGL

SEQ ID NO: 770939 - protein, 287 aa, Homo sapiens [sequence omitted]

SEQ ID NO: 770940 - protein, 411 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770941 - protein, 427 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDEKQIGPVSDKCIHGYQGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770942 - protein, 275 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGLVQVPKLCISWDESNHGIILMIPKQKVSKVRPMIPT

SEQ ID NO: 770943 - protein, 138 aa, Homo sapiens
FDGDSPRRFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770944 - protein, 142 aa, Homo sapiens
GLLATAESDEYTFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770945 - protein, 357 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVKMSQEPYHICPLGRSQLWHSRLYPRKNGRNDGNRARLIIWEQIPLTTSRGNLTLTSSRNTAFFCEHIHFTSLVSDT

SEQ ID NO: 770946 - protein, 125 aa, Homo sapiens
HPSPASASQVAVITGLVQVPKLCISWDESNHGIILMIPKQWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770947 - protein, 145 aa, Homo sapiens
TPFSCLSLPSSCDYRFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770948 - protein, 340 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTVVEHLYHQRFTSASTIWPCQRHLLICKCGRFCFF

SEQ ID NO: 770949 - protein, 293 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVAARVSECNSPFR

SEQ ID NO: 770950 - protein, 269 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDISAFKVLVQCPSC

SEQ ID NO: 770951 - protein, 411 aa, Homo sapiens; identical to SEQ ID NO: 770940

SEQ ID NO: 770952 - protein, 411 aa, Homo sapiens; identical to SEQ ID NO: 770940

SEQ ID NO: 770953 - protein, 411 aa, Homo sapiens; identical to SEQ ID NO: 770940

SEQ ID NO: 770954 - protein, 411 aa, Homo sapiens; identical to SEQ ID NO: 770940

SEQ ID NO: 770955 - protein, 411 aa, Homo sapiens; identical to SEQ ID NO: 770940

SEQ ID NO: 770956 - protein, 143 aa, Homo sapiens
HAATTLLIFHRYRFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770957 - protein, 142 aa, Homo sapiens
VAAVTLLYPPLRFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 770958 - protein, 428 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVLSDLVYTLAFSCGFCRKEDVSGAISHLSLGEIPAMAQPFVSSEERKERWEQGQADYMGADSFDNIKRKLDTYLQ

SEQ ID NO: 770959 - protein, 428 aa, Homo sapiens; identical to SEQ ID NO: 770958

SEQ ID NO: 770960 - protein, 241 aa, Homo sapiens
GRRGTRSPAGHRPCRPRSWEDADGSESVRGHVTAAIRAHGADARFPAVPPRWPRSLPVPASLSHQPEAAPAACAPGSTMTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGNK

SEQ ID NO: 770961 - protein, 293 aa, Homo sapiens; identical to SEQ ID NO: 770949

SEQ ID NO: 770962 - protein, 121 aa, Homo sapiens
MRAELIAAPRQVFFKKAKGAPQKEGGANNKTNKQAAGAARVVKTTGAAAGGKKNVATVDELFMEEERDPNSSGAEAAIMVEEANYTYETEYIKRHGRKIYNKSFARVCNDGVKTRKRIINA

SEQ ID NO: 770963 - protein, 536 aa, Homo sapiens
MILLSFVSDSNVGTGEKKVTEAWISEDENSHRTTSDRLTVMELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 770964 - protein, 314 aa, Homo sapiens
DPFNISFLRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 770965 - protein, 496 aa, Homo sapiens
MELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 770966 - protein, 496 aa, Homo sapiens; identical to SEQ ID NO: 770965

SEQ ID NO: 770967 - protein, 338 aa, Homo sapiens
QYVMIAEPAVKLQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 770968 - protein, 94 aa, Homo sapiens
VCHIFASFNDTFVHVTDLSGKQTICRVTGGMKVKADRDESSPYAAMLTTQDVAQRCKELGIIALHIQLRATGGNRTKTLGPGPSRPSEPLPARV

SEQ ID NO: 770969 - protein, 800 aa, Homo sapiens
RSQAGSGGSDASAAMGSGGVVHCRCAKCFCYPTKRRIRRRPRNLTILSLPEDVLFHILKWLSVEDILAVRAVHSQLKDLVDNHASVWACASFQELWPSPGNLKLFERAAEKGNFEAAVKLGIAYLYNEGLSVSDEARAEVNGLKASRFFSLAERLNVGAAPFIWLFIRPPWSVSGSCCKAVVHESLRAECQLQRTHKASILHCLGRVLSLFEDEEKQQQAHDLFEEAAHQGCLTSSYLLWESDRRTDVSDPGRCLHSFRKLRDYAAKGCWEAQLSLAKACANANQLGLEVRASSEIVCQLFQASQAVSKQQVFSVQKGLNDTMRYILIDWLVEVATMKDFTSLCLHLTVECVDRYLRRRLVPRYRLQLLGIACMVICTRFISKEILTIREAVWLTDNTYKYEDLVRMMGEIVSALEGKIRVPTVVDYKEVLLTLVPVELRTQHLCSFLCELSLLHTSLSAYAPARLAAAALLLARLTHGQTQPWTTQLWDLTGFSYEDLIPCVLSLHKKCFHDDAPKDYRQVSLTAVKQRFEDKRYGEISQEEVLSYSQLCAALGVTQDSPDPPTFLSTGEIHAFLSSPSGRRTKRKRENSLQEDRGSFVTTPTAELSSQEETLLGSFLDWSLDCCSGYEGDQESEGEKEGDVTAPSGILDVTVVYLNPEQHCCQESSDEEACPEDKGPQDPQALALDTQIPATPGPKPLVRTSREPGKDVTTSGYSSVSTASPTSSVDGGLGALPQPTSVLSLDSDSHTQPCHHQARKSCLQCRPPSPPESSVPQQQVKRINLCIHSEEEDMNLGLVRL

SEQ ID NO: 770970 - protein, 300 aa, Homo sapiens [sequence omitted]

SEQ ID NO: 770971 - protein, 800 aa, Homo sapiens; identical to SEQ ID NO: 770969

SEQ ID NO: 770972 - protein, 106 aa, Homo sapiens
MSSSFPGASVSMSVQMTHKPSTPVLRQLLSSTAALAAAQSLLGGYSTGTLHSTHPILSQLLIPQTTSPLVSNLNNQYQYTSSYSVLKPPSSPKMSLRSTFLLHCPS

SEQ ID NO: 770973 - protein, 253 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSREDLIKVLLASSFVPIYAGLKLVEYKGQKWVDGGLTNALPILPVGRTVTISPFSGRLDISPQDKGQLDLYVNIAKQDIMLSLANLVRLNQALFPPSKRKMESLYQCGFDDTVKFLLKENWFE

SEQ ID NO: 770974 - protein, 132 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLHVSITNAKTRENHLVSTFSSS

SEQ ID NO: 770975 - protein, 253 aa, Homo sapiens; identical to SEQ ID NO: 770973

SEQ ID NO: 770976 - protein, 253 aa, Homo sapiens; identical to SEQ ID NO: 770973

SEQ ID NO: 770977 - protein, 132 aa, Homo sapiens; identical to SEQ ID NO: 770974

SEQ ID NO: 770978 - protein, 66 aa, Homo sapiens
DCFFFFRSGMESILPPSAHELAQNRLHVSITNAKTRENHLVSTFSSREDLIKVTKPCFLFEEISKC

SEQ ID NO: 770979 - protein, 57 aa, Homo sapiens
EECSMREETEPCGFPGLDSSPAIVVTSGCHKKISKTGSLKQQILISHSVGVFKVQDQ

SEQ ID NO: 770980 - protein, 258 aa, Homo sapiens
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQMVWATSNRIGCAIHTCQNMNVWGSVWRRAVYLVCNYAPKGNWIGEAPYKVGVPCSSCPPSYGGSCTDNLCFPGVTSNYLYWFK

SEQ ID NO: 770981 - protein, 188 aa, Homo sapiens
MIAISAVSSALLFSLLCEASTVVLLNSTDSSPPTNNFTDIEAALKAQLDSADIPKARRKRYISQNDMIAILDYHNQVRGKVFPPAANMEYMVWDENLAKSAEAWAATCIWDHGPSYLLRFLGQNLSVRTGRYRSILQLVKPWYDEVKDYAFPYPQDCNPRCPMRCFGPMCTHYTQVISITLLIFDSYF

SEQ ID NO: 770982 - protein, 102 aa, Homo sapiens
MILGVYADGLILIITTILFNRYYHHSSFTEEKTDELGNFARVTHLASGGARRELRWSWLQSPQPQGSAAYKFNAQPSKEALLVRALGDELHGVFHILQPDPS

SEQ ID NO: 770983 - protein, 65 aa, Homo sapiens
DRARSLFWHPVLRTLKNRIEENTGHTFNSLLCNLYRNEKDSVDWHSDDEPSLGRCRGIGGADEER

SEQ ID NO: 770984 - protein, 286 aa, Homo sapiens
MEEKRRRARVQGAWAAPVKSQAIAQPATTAKSHLHQKPGQTWKNKEHHLSDREFVFKEPQQVVRRAPEPRVIDREGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 770985 - protein, 286 aa, Homo sapiens; identical to SEQ ID NO: 770984

SEQ ID NO: 770986 - protein, 145 aa, Homo sapiens
MFPGNRGPASERWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 770987 - protein, 153 aa, Homo sapiens [sequence omitted]

SEQ ID NO: 770988 - protein, 145 aa, Homo sapiens; identical to SEQ ID NO: 770986

SEQ ID NO: 770989 - protein, 286 aa, Homo sapiens; identical to SEQ ID NO: 770984

SEQ ID NO: 770990 - protein, 258 aa, Homo sapiens
ASSELRLIGRGQTWKNKEHHLSDREFVFKEPQQVVRRAPEPRVIDREGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 770991 - protein, 153 aa, Homo sapiens [sequence omitted]

SEQ ID NO: 770992 - protein, 143 aa, Homo sapiens
PGVCPGWTEGFPPLSRQGPSLRCEDTWLTLNSQLQGNLPAVSPPRLSRSPWRSFFVSPMARTRGRHPSLALVVVLPFVGNVLSSLPPEDPSASRPSSDAPSSRKPSRVLSSGFLHKILKLPHRPLKKIHLFEVQSHIFVRRMN

SEQ ID NO: 770993 - protein, 71 aa, Homo sapiens
LTLYATVTLASFLFLEHTGYAPMHALAISSIWNTLSPRYHMTHYITFFSSLMKRHFGLGRWLTCNPNTLGG

SEQ ID NO: 770994 - protein, 52 aa, Homo sapiens
EKALAQRSDFPSVTEAGNGRAGRTKRSLTRPASISGPHWRLNPLQSEGTTST

SEQ ID NO: 770995 - protein, 589 aa, Homo sapiens
MCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 770996 - protein, 169 aa, Homo sapiens
MEGGERGGARRGWRPPRRRGTPLSPGPGDPGDEPPARPRHRAHPPCGSQAPTARPSPPARRLPRTQGLGGWGGGRPEASQPWAPPPRPGCRVHPAFPAVAAPSRAPGAEACTHRPASATPRPWLRVWSRPPPSARRPWGGVSPRRPLPARAARRPDFPRPNTGGDRGAR

SEQ ID NO: 770997 - protein, 116 aa, Homo sapiens
MERGLHHPLGHMACVEGAAAPWELRVQNQGQRGWPWGQATLGSNPDCCCATEHVPELSGPQSHAGWMSGISGLPCATKAPRAGLVQDVRPPVPHTIFLMRARATKVLCRHQHLLTW

SEQ ID NO: 770998 - protein, 67 aa, Homo sapiens
AHTPGDLKSKIKVLTRSKSGEGPVLGVRDVQLVFMFSHGLSWVCAHREHSGNSSYKSLNPIMRAPIP

SEQ ID NO: 770999 - protein, 181 aa, Homo sapiens
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVR

SEQ ID NO: 771000 - protein, 124 aa, Homo sapiens
HLRWTDQNADFRDHAAPLGAGRKCSREQDTFPPHSLSDPPGAELLIQVPLTPGRSDAVSARGTHRAREENSGPQAPQPHNLCSNPCPPGQSLGWLRVPDLASTAPLVVGNTRSVLESMVSMDSA

SEQ ID NO: 771001 - protein, 106 aa, Homo sapiens
MAVNLQKLTCPSMHTFQPVVMYIRLMLASVFPKEARLSLFYKRENKAKMLGFSYDLQGTMQSQEKKFAGFAGLSKISGGSVLGFNQFNIGSLTYTRCVTHACNPSI

SEQ ID NO: 771002 - protein, 128 aa, Homo sapiens [sequence omitted]

SEQ ID NO: 771003 - protein, 177 aa, Homo sapiens
MGGHPDEVPQQARGLPVMLETAAAGSRAKNNRRNTRRANHPSQQETLPVGSGPEYEGPRTPEGRAPAKNHAPASRETTKVRPQHDSTVRPHAPNGNKGRKTGEQPNRRYRRDDTQSKAAEATTHNRKQHRERTGQQGDEGTDTPHKRPRTGRKHGAHNRNRERTQPRTTDTAEPPAR

SEQ ID NO: 771004 - protein, 177 aa, Homo sapiens; identical to SEQ ID NO: 771003

SEQ ID NO: 771005 - protein, 128 aa, Homo sapiens [sequence omitted]

SEQ ID NO: 771006 - protein, 316 aa, Homo sapiens
MFQNLRILELTPGVTDPERVEQGVVLRCFSLGERPSSPCHQPLPVPRSPPAQPRTAQRPPSPSCHRLRAAKLAAPGALAPSGPQKHSHLLQGHPLGWGQEPVSSWQSQSSLRPWRKGLQHTLDRGRAGHLFQAGPGWNTCPLRLHSGHMPCQDPEPGFGGLGQGQQGLCPGGVSAGGGAGPAESPGGLCWALLSRTPSPPALTLRCHVCTSSSNCKHSVVCPASSRFCKTTNTVEPLRGNLVKKDCAESCTPSYTLQGQVSSGTSSTQCCQEDLCNEKLHNAAPTLRCHVCTSSSNCKHSVVCPASSRFCKTTNTV

SEQ ID NO: 771007 - protein, 132 aa, Homo sapiens
MRGLRKRRWVRVSPTEARIQVEGSPERWLENVEGAGGHPSILKAIPMAKINSVIWIPSRHLKSYHEPDAEEETPGGSRGRPSCSHVETDAEEDPNCHEQHLSNTATHLGTDQEAVTDGRRKPEESGTTSHNE

SEQ ID NO: 771008 - protein, 109 aa, Homo sapiens
MSQMLRKRLREDPEDGPVAAMLRLTLRRTPTVTSNTCRTQPPTWGQIKKLSQMAEENLRKAGQPVTMSNFMVAMIAVITTAVSIPSTRADTQNNYTYWAYLSTLAGNNA

SEQ ID NO: 771009 - protein, 204 aa, Homo sapiens
MHRRRLALGLGFCLLAGTSLSVLWVYLENWLPVSYVPYYLPCPEILPMMMALSASATSNMKLHYKREKPLQPVVWSQYPQPKLLEHRPTQLLTLTPWLAPIVSEGTFNPELLQHIYQPLNLTIGGHGCLPWGSTLISSSPSLESAEEFFMRGYRVHYYIFTDNLQTFRGPLGPTGSQSSPSGHSHGKRIHGRWKHSRMVEGHGR

SEQ ID NO: 771010 - protein, 115 aa, Homo sapiens
IFCDGVSLCHPGWSAMVPSWFAATSASQGPRPPPSLGAEDLQASQSQELCEGLLLNSLRDLDLSGVTDEGGSERPGPGCPRGRLTLSRGGASTLSSPHQLLLVPLPSPGELPRLA

SEQ ID NO: 771011 - protein, 423 aa, Homo sapiens
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 771012 - protein, 423 aa, Homo sapiens; identical to SEQ ID NO: 771011

SEQ ID NO: 771013 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPTSNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 771014 - protein, 317 aa, Homo sapiens; identical to SEQ ID NO: 771013

SEQ ID NO: 771015 - protein, 407 aa, Homo sapiens
TQESPRCPDVMPLTCALGVREKRAALTSRLGLAEGSGPGPVRSQGSEQTGQPEDRIPWRPQRSTKEKICLWVPIAQLLPALLPAALSRVIMSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPTSNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 771016 - protein, 103 aa, Homo sapiens
GAARRRGNLTLGEYFTSIQSSESTASSHFQQERFPFRRRFNPAAGKADWEIHFGWAISFNEAGRREAAAGPACLPVFRNLNSHLVQFIRCGTVLLCVWCARGE

SEQ ID NO: 771017 - protein, 260 aa, Homo sapiens
MGNFSQHGGRTVPPQPLKSGSIISVHQGSRCRDIGEQKAFRHVSRVLTTGWSLEEVRISSYSALCLPHPWTHPAQPRTESINSAPPMEDSLVQPQSLRFPRCPIDSPRVPRAVGKPAPLSQGPCPDCSLAARGLIAGVLGVPLWCSLSHPQPPDGLGLYSFPLPTGLGPSPDSRSEVTFVPEGAVFTVSPGPLHMLLFFCLECSSYLPTLHVKPYLGLDITSSRKLSQTSPCQGGHTVPDLPLRYQISLNCNCIYFVFSS

SEQ ID NO: 771018 - protein, 236 aa, Homo sapiens
GPSTCLGLSLSLGRGAPGDPGHLATGRRGMGGRKPDGAGRRRGVLGGVKEGERGRAWGAELRATEPGRGVQARATAFAAAGNAGSRGTQRAGEEGGGLRGRRGEGTAESAGPVGSRRGAEQILKAGGGRTFRRGRVPPDTASARYSSAEVIVLQRRVQLVRWGPRGGGCGRGSRGRDRSGGRDFRVGSPGGGVRGGRRLLLLLQLPESAEGHGSGAGRPSETALAPLGGAGGGWGM

SEQ ID NO: 771019 - protein, 132 aa, Homo sapiens
TNRPSQGTDSYQSLAPKIIYPFPFCLPSFHKSFEEAVPVFALMGLLHLFINLWPISILCSKYIYIFKLNLQLVSNFTSVYFFIIRFFHFLIFCVTTWEAEAENCLNLGGGGFSERRSSTCTLAWVTETDSVS

SEQ ID NO: 771020 - protein, 746 aa, Homo sapiens
MSNSHPLRPFTAVGEIDHVHILSEHIGALLIGEEYGDVTFVVEKKRFPAHRVILAARCQYFRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSLRCGRLVAAHYPPAQAPTHAPPTGSTNKGGSGPGVTWWARATAGNGLLPEQGSLLTAPTSAPFQGGADLAAKADTEQVFSQGQKGAALFFSIYPNQAGLKGEKMGLQSSSSPPLTPYLSNLAQAQGTGGSHRQACVGIQKWHANTQAEEKAIGPLLPGGTL

SEQ ID NO: 771021 - protein, 447 aa, Homo sapiens
MSNSHPLRPFTAVGEIDHVHILSEHIGALLIGEEYGDVTFVVEKKRFPAHRVILAARCQYFRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIGYYFGIVTLKVDTVEHLGEKRKRPHE

SEQ ID NO: 771022 - protein, 168 aa, Homo sapiens [sequence omitted]

SEQ ID NO: 771023 - protein, 746 aa, Homo sapiens; identical to SEQ ID NO: 771020

SEQ ID NO: 771024 - protein, 108 aa, Homo sapiens
LDQAIWHWLIECELHWGCCEPAWVSVTLQMQPCPGTGQWVWAGVSPVCHPGPGPLSVSAMTMVSLVGLRLCLGFLRVLCRSVDSFSCCLGNCGNEHWQVLKRACGRAI

SEQ ID NO: 771025 - protein, 70 aa, Homo sapiens
QHFWQLRSPVLQLTKLPSGARTRNAVIKRCRLEKFEQPGPRFPICEGALRLGRTWAIFVLPLAHEPLHQS

SEQ ID NO: 771026 - protein, 406 aa, Homo sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 771027 - protein, 319 aa, Homo sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 771028 - protein, 169 aa, Homo sapiens [sequence omitted]

SEQ ID NO: 771029 - protein, 398 aa, Homo sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGASRTILLLGRPDGKGGHEIGSKSASRWDWDPRTGCRRAELGLPKGNADLSPTPTWTRIRRQTPRACAPGRRAAKRRPGQPRVRTAVGNARSRGEGGREHSRVKEVKRPRALPGQPGGF

SEQ ID NO: 771030 - protein, 129 aa, Homo sapiens
PDAVLRPRAVSAAQEFTVCSICSSTEGPWNGDGTPDAWTSGFLVAKPALISLLEQGEEPGALILQVAEQSVAKASLCTEDPNTLPSRSQEGSPASSEGGPGEKGVAGRVAGGGAASSWPHGEHPVTPNR

SEQ ID NO: 771031 - protein, 134 aa, Homo sapiens
GSWRSIVSECVRMFSVDSVKICPQRGQAHPLGWGPRWNTKGEDKQILFSGGRHPSPALGHQDSRFFGLWTQACHRGLPGLSASQPQNESYTTGFLGSTTFLPGLSLTYSFSRSPACRQPMGGLLSLHKCVGQFA

SEQ ID NO: 771032 - protein, 182 aa, Homo sapiens
PDAVLRPRAVSAAQEFTVCSICSSTEGPWNGDGTPDAWTSGFLVAKPALISLLEQGEEPGALILQVAEQSVAKASLCTDSRMEAGIMESPLQRKLSRQAGLPGTVWGCLPWGHPVGGHPAPSHPHGGPEDGSDKPTHPGSSCRTIGHSQALAPGSVWRSIPGAVKPTNRVQGALAGCHVSCL

SEQ ID NO: 771033 - protein, 141 aa, Homo sapiens
MEAGIMESPLQRKLSRQAGLPGTVWGCLPWGHPVGGHPAPSHPHGGPEDGSDKPTHPRAREHSASPRVLQERPGPAHLGETTASSVYTVQGAAHGWCSIPSTPCCIQAFPIIPITRSASNLPVTPDCGKALLAHARFLHRK

SEQ ID NO: 771034 - protein, 167 aa, Homo sapiens
GFLMTGTTGRGFTLEAHPSRRGPSRRNSEAPCPEGEAKSKERASSHQELGFLLQPGTGEGKGTRQPVVWPQEPLSATISWGLPEMSRSGQKGEREGQLCSVPKEQGTGGATDAYAAELPTGRPGSSCRTIGHSQALAPGSVWRSIPGAVKPTNRVQGALAGCHVSCL

SEQ ID NO: 771035 - protein, 295 aa, Homo sapiens
NPQALGPCGIQAAMAPSFTARIQLFLWRALGFLIGLVGRAALVLGGPKFASKTPRPVTEPLLLLSGMQLAKLIRQRKVKCIDVVQAYINRIKDVNPMINGIVKYRFEEAMKEAHAVDQKLAEKQEDEATLENKWPFLGVPLTVKEAFQLQGMPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPGVGPKQKVRYPLAVGAQELVPVHWSYVPYCGRPGT

SEQ ID NO: 771036 - protein, 356 aa, Homo sapiens
RQGAAGPGGGGDPGPTGRVLLPFRAVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 771037 - protein, 55 aa, Homo sapiens
MALGRNERRAQEDEDLGIRGDGREEEKEEENRVDEENGSREAERDRDVKKRREES

SEQ ID NO: 771038 - protein, 68 aa, Homo sapiens
VDNKSTAQNVEGIIVSAMFKSLITRCASTTHELHSPENLVRSSPLFPQELSVSALRKVLIVVAMSKRS

SEQ ID NO: 771039 - protein, 279 aa, Homo sapiens
YVVWKQKLELKSCEMKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSEHQLTPLPPSAPPSADDNIKTPAERLRGPLPPSADDNLKTPSERQLTPLPPSAP

SEQ ID NO: 771040 - protein, 106 aa, Homo sapiens
SFSCGPQAGCTPKSCWNSRPLPAPVVLQQQGALTLRPQTCIQEIWSGQAAASDGLEAGHWPQAAGPAKMEAGGWQQPCLWMPHMGDPKTVFKNLGLYKAGRGSSCL

SEQ ID NO: 771041 - protein, 287 aa, Homo sapiens
MSALGQITITVSRCWNTERNQTDKNPCLHGAYLQLRETVKNKSTHLKKPLMKQAPPWKDHLTFQPLHPAERKTQVWRWQSGNSSDLETTSSASPWPTGSNRDVVLNTLAESCCGLSELITAPPYAGVSIQGFSQIWVLFPFCGGTFHHNEKDVLGLQDFERLPMAEHEPISTHFPASEPIKTLDSARLRQKSGLTAVGRSYPLPVSLTLQDYLPAGTSYPPWVSSPLRAGHLPGRPVCGKELPTLCLLRAPLLLSEAPLHLARPPVVQAFHSSWTQDKNLGPAKWWG

SEQ ID NO: 771042 - protein, 123 aa, Homo sapiens
LACPIGAAGGGVRPPDPRTPVRAPPWCSRLWRARPVPGSRVRKGPPRSPAVDWREDPRLGQPSSPRPGAGIPMGKSARRGWGSWCLRPRPVSFTSVRQERWLRAGPTQLEPPSLLRDQSTGKT

SEQ ID NO: 771043 - protein, 31 aa, Homo sapiens
MALRLVADFDLGKDVLPWLRAQRAVSEASGA

SEQ ID NO: 771044 - protein, 114 aa, Homo sapiens
MAAEAPQRPKSDWAGRAQAPSLGEGGAKNGKSHPGSHRAFSLPRAPRRLGPGSQPGRFRGFLKQARGRAGEGHSAILLAPESPNAQVSNVTSATYRSNLSSFPRPCSVLLPGGP

SEQ ID NO: 771045 - protein, 101 aa, Homo sapiens
IAGGGGEGWGSGSAYIVEYWCQRVPKHQAGVRRATIPRPGSPIWYDSLISLSVNVLSFLLTSAPRDGEGNYLPWCQNFYFLLLLGFRHRESKTEQRYQKKT

SEQ ID NO: 771046 - protein, 161 aa, Homo sapiens
MVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCTFNHDSGITQP

SEQ ID NO: 771047 - protein, 109 aa, Homo sapiens [sequence omitted]

SEQ ID NO: 771048 - protein, 97 aa, Homo sapiens
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVI

SEQ ID NO: 771049 - protein, 225 aa, Homo sapiens
MAEGLKFKDVVIYFSQKEWECLHSAQKDLYRDVMLENYGNLVLLGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCTFNHDSGITQP

SEQ ID NO: 771050 - protein, 208 aa, Homo sapiens
MAEGLKFKDVVIYFSQKEWECLHSAQKGLSDTKPNVISLLEQKKEPWMVKRKETKEWCPDWEFGRETKNLSPKENIYEIRSPQQEKARVIREIRCQVERQQGHQEGHFRPAVIPFTSMQCTAHREYQWLHTGEKSCECRKCKNAFRYQSCPIQHEIIHNKEKEPECGECRKIFNSGSDLIKHQTLHESKKHSENNKCTFNHDSGITQP

SEQ ID NO: 771051 - protein, 78 aa, Homo sapiens
MGHLLSKEPRNRPSQKRPRCCSWCRRRRPLLRLPRRTPAKVPPQPAAPRSRDCFFRGPCMLCFIVHSPGAPAPAGPEE

SEQ ID NO: 771052 - protein, 139 aa, Homo sapiens
RRGQGGSEMAFFNLYLLGYQNSFQNKKRNTTEETNQKEPEPTRLPPIISKDGNYSVHQNSHTRYHEAVRKVLLKTFPNQVFRIPLTDAQNFSFWWSHDPGVRPEETMPWIRSPRHCLIKSAMTRFMDHSILNDRTFSLY

SEQ ID NO: 771053 - protein, 159 aa, Homo sapiens
MFPFALLYVLSVSFRKIFILQLVGLVLTYDFTNCDFEKIKAAYLSTISKDLITYMSGTKSTEFNNTVSCSNRPHCLTEIQSLTFNPTAGCASLAKEMFAMKTKAALAIWCPGYSETQINATQAMKKRRKRKVTTNKCLEQVSQLQGLWRRFNRPLLKQQ

SEQ ID NO: 771054 - protein, 1131 aa, Homo sapiens
MFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 771055 - protein, 1131 aa, Homo sapiens; identical to SEQ ID NO: 771054

SEQ ID NO: 771056 - protein, 367 aa, Homo sapiens
DAWVDPRVRVRGRAAAPCREAARGRGQRRFLPPTWRCETGAATMFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 771057 - protein, 382 aa, Homo sapiens
LVPPLLPLVLSATCCPDTSRAGRRVRGRAAAPCREAARGRGQRRFLPPTWRCETGAATMFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 771058 - protein, 88 aa, Homo sapiens
GSYPSADRQAQAAATQKQTSHDLGSLPPANPALHPGTALNRLLLENTLQGQARWLTPVIPALWEAKVGRSRGLEFKTSLAKMVKPRLY

SEQ ID NO: 771059 - protein, 55 aa, Homo sapiens
GLTITPESTTEVELSPVVQETPTQPPKKVVAQLPVYQEVTVPTPGQDQAQHPMSP

SEQ ID NO: 771060 - protein, 95 aa, Homo sapiens
MVILGCAPLQRPLHQTLWAPDQLACCPYNFFKQLSLPTQVSLLAEGFPPAEIPEACAQSRLLSASSPNLCPQHIGGQEQVPVCGSPMQRSQIPSP

SEQ ID NO: 771061 - protein, 731 aa, Homo sapiens
SLSCTPVHPPVFRRALFVCAQPRCALCSSQLPGPAAMADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 771062 - protein, 125 aa, Homo sapiens
NGLLFSLQIFTAMPPFTLGVFQRSCTRESMLRFPQLYKITQNAKDFNTRVNKVDLRIVTSKRPCLPLFSSGHLPMRYLKLEREHLKITETVTPIPAHTASQVGYRDFFLGDEFTPHGVCSPVPVC

SEQ ID NO: 771063 - protein, 89 aa, Homo sapiens
WVWLSRCVGLRGGGRVDAAELRPEVGDRRWGTTESDVWRVRLRVGGRAGTAATREPGASWVRVTHEPAPSRGPGVCEEPWRRPPASRFF

SEQ ID NO: 771064 - protein, 30 aa, Homo sapiens
MLTGMVLISRLHDPSGSASQSAGIIGMSHC

SEQ ID NO: 771065 - protein, 1173 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFYAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 771066 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFYAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 771067 - protein, 128 aa, Homo sapiens
MSPSQLPLQCFPPVPGARSTAWRRPSNKNLPQHMRTRTLGLTRSHTHTCTHTHIWGPAHLQNEGTTKVAEDLSGRAFARTQIHSTRVQPATGSSSGLRKTRTGRRKRRKRRTKRGRRRFFVQRRKEKK

SEQ ID NO: 771068 - protein, 1249 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFYAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 771069 - protein, 86 aa, Homo sapiens
RTLMELRGAEALQKIEEAYGDVSGLCRRLKTSPTEGKSLSGCMPPSPAPSLQRSDLKASLAPRLARVKGHLCPSSQPFPLRGRCPG

SEQ ID NO: 771070 - protein, 1168 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFYAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGSES

SEQ ID NO: 771071 - protein, 285 aa, Homo sapiens
PGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETHNQTARGFCLRPHALSVDDVFQGADWERPGSPPSYEEAMQGPAARLVASESQTVGSMTVGSMRARMLEAHCLLPPLPPAHHVEDSRHRGSKEPLPGHGLSPLPERWKQSRTVHASGDSLGHVSGPGRPELLPLRTVSESVQRNKRDCLVRRCSQPVFEADQFQYAKESYI

SEQ ID NO: 771072 - protein, 175 aa, Homo sapiens
YFSSQVKTLVEFLIDNCFEIFGENIPVHSSITSDDSLEHTDSSGMCRPCRMTQPTTATTLMWNPTAAVASALPAGSPRCPWPQLLAWIARAHRMPERSAQSPLLSPLPERWKQSRTVHASGDSLGHVSGPGRPELLPLRTVSESVQRNKRDCLVRRCSQPVFEADQFQYAKESYI

SEQ ID NO: 771073 - protein, 116 aa, Homo sapiens
YFSSQVKTLVEFLIDNCFEIFGENIPVHSSITSDDSLEHTDSSVLSPLPERWKQSRTVHASGDSLGHVSGPGRPELLPLRTVSESVQRNKRDCLVRRCSQPVFEADQFQYAKESYI

SEQ ID NO: 771074 - protein, 122 aa, Homo sapiens
MPHRQIGVSKVRAMPSPQTEAAEGRVLRLMAVGVVPRPSCPREARPGLGGGIRWFHMVQFCALATRWQPKLRDGAAVSRLAVLVPVRPGTLDQGTDGGPLPCGCPRDQPKKDAALILLHSPV

SEQ ID NO: 771075 - protein, 98 aa, Homo sapiens
RRPSYGYGKDRPVAEAGQSTGIPGCFMKGPYIQSDLQIQKELEKLKNEGDKSSLSAKGDLLGNFTDRSMVLDSSKTGSPCHVLRTGEQPGGEIYLVGN

SEQ ID NO: 771076 - protein, 101 aa, Homo sapiens
QTSLGGQAVGRSAGLAKQNICVSVYVLFICRLGQGLRGRSPQLMPSCEQQYLTFYQPLAAEEQDHNPGGSANIPSMVENVSSSSHMEFTDDGFPTSRRGTS

SEQ ID NO: 771077 - protein, 58 aa, Homo sapiens
FLGIMNDFLIDIFEHITTKAGCQVATLSAPLSPPERSRPPEPDAVWGYPQTRCIENQR

SEQ ID NO: 771078 - protein, 88 aa, Homo sapiens
MSILIRLLPVILLLVEGVQVLGILKKELKKTHKQSKEGMKGFIENESTLHSVGTGEHRGSKAALQNFGEFKYPLEDSIGYFGYALCKG

SEQ ID NO: 771079 - protein, 261 aa, Homo sapiens
MSKSGFGSYGSISAADGASGGSDQLCERDATPAIKTQRPKVRIQDVVPCNVNQLLSSTVFDPVFKVRGIIVSQVSIVGVIRGAEKASNHICYKIDDMTAKPIEARQWFGREKVKQVTPLSVGVYVKVFGILKCPTGTKSLEVLKIHVLEDMNEFTVHILETVNAHMMLDKARRDTTVESVPVSPSEVNDAGDNDESHRNFIQDEVLRLIHECPHQEGKSIHELRAQLCDLSVKAIKEAIDYLTVEGHIYPTVDREHFKSAD

SEQ ID NO: 771080 - protein, 104 aa, Homo sapiens
GKRLSMKFLTESRGQSPRLSESYSEPQEEVPYASSQGNSKQSAGRNSVTQMKMMVSHHSSMQFSKGQDRDIWLFQWCQASSRRNRGCGKGNRWQMKETRNCHYP

SEQ ID NO: 771081 - protein, 453 aa, Homo sapiens
QVNPREPSQCSGNTEYKVALLTLKRKFCLSSSALPSPAQPTQPHLFPVDHIPPCSPEPPRKGLRGPHGLPLPVAPQPPWARGSAPEAEVPTMGNHTWEGCHVDSRVDHLFPPSLYIFVIGVGLPTNCLALWAAYRQVQQRNELGVYLLNLSIADLLYICSLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKVMTGSWAATPPSQGDQVQLKMLPPAQ

SEQ ID NO: 771082 - protein, 48 aa, Homo sapiens
MLTCQVGAIVTHFTEEKTEVRQLASNLALSDSEVFILSRDVLLPPHSF

SEQ ID NO: 771083 - protein, 197 aa, Homo sapiens
MGATHGNWEVPSQMQGFHRRSPRATKCSPVPGSSQHHGLNTYWASSSGPGWGMWGHEGAQSGRQRDKCAQRAPISGCNVVLRFWLRRVSRVSYVLWSCFLSPASPCRNPSEYIATLFELSALMVYWHQQICLCMDFLYYPFLRGDASAGPMTWCTTLDTIILEQHCTLTSQGVHDFLKAKATFKTWDFSDALVLGKV

SEQ ID NO: 771084 - protein, 111 aa, Homo sapiens
KRELTLLTTTATDIMEIRTVAVRIVAIKGVESEFYLAMNEEGKLYAKKECNEDCNFKELILENHYNTYAAAKWTHNGGEMFVALNQKGIPVRGKKTKKEQKTAHFLPMAIT

SEQ ID NO: 771085 - protein, 67 aa, Homo sapiens
RISAIGRDTCHLRSHNSKPRNARAPLTCYAYRVIISRVLGLGAIQRDEPPALTWPLGREKHTATTSE

SEQ ID NO: 771086 - protein, 84 aa, Homo sapiens
MDGQVGMAARRQGLRCQPNQPDHDSRWYTVGLDLEGAEESLCHTRTPWAPEQSTGLQTRMTLNAAGPSAALLEGLLLGGWEAID

SEQ ID NO: 771087 - protein, 43 aa, Homo sapiens
AHRLGGLFCTRWATNKLTYATYLLPTAPTSLVKYGEKKAKALS

SEQ ID NO: 771088 - protein, 396 aa, Homo sapiens
RELGREESARLSTARALRLSGAARWPKHSAGESAMSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 771089 - protein, 111 aa, Homo sapiens
RELGREESARLSTARALRLSGAARWPKHSAGESAMSENGSFANCCEAGGWAVRPGWSGAGSARPSRTPRPPWVAPALSAVLIVTTAVDVVGNLLVILSVLRNRKLRNAGFW

SEQ ID NO: 771090 - protein, 632 aa, Homo sapiens
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 771091 - protein, 632 aa, Homo sapiens; identical to SEQ ID NO: 771090

SEQ ID NO: 771092 - protein, 632 aa, Homo sapiens; identical to SEQ ID NO: 771090

SEQ ID NO: 771093 - protein, 632 aa, Homo sapiens; identical to SEQ ID NO: 771090

SEQ ID NO: 771094 - protein, 551 aa, Homo sapiens
MKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 771095 - protein, 292 aa, Homo sapiens
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQVFFHFLVITFISNSE

SEQ ID NO: 771096 - protein, 632 aa, Homo sapiens; identical to SEQ ID NO: 771090

SEQ ID NO: 771097 - protein, 632 aa, Homo sapiens; identical to SEQ ID NO: 771090

SEQ ID NO: 771098 - protein, 632 aa, Homo sapiens; identical to SEQ ID NO: 771090

SEQ ID NO: 771099 - protein, 632 aa, Homo sapiens; identical to SEQ ID NO: 771090

SEQ ID NO: 771100 - protein, 130 aa, Homo sapiens
MDSELRFRTGHSGFSLRHAQSTLYLQFPESKSKAIVISVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 771101 - protein, 125 aa, Homo sapiens
MPHSSDSSDSSFSRSPPPGKQDSSDDVRRVQRREKNRIAAQKSRQRQTQKADTLHLESEDLEKQNAALRKEIKQLTEELKYFTSVLNSHEPLCSVLAASTPSPPEVVYSAHAFHQPHVSSPRFQP

SEQ ID NO: 771102 - protein, 253 aa, Homo sapiens
MAPKVFRQYWDIPDGTDCHRKAYSTTSIASVAALTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVYCKTKDVSPVNCRDLQPAKNAVQNIKILVSCVMKKTTKQNTHNHPHGKHIVRAARHKRRAHQTADPLGRKRWTHLEPHRLSDDNHAGTNRQGTATKETHTNQNRNKTGVTMRVSSPQT

SEQ ID NO: 771103 - protein, 96 aa, Homo sapiens
MAPKVFRQYWDIPDGTDCHRKAYSTTSIASVAATGWDSSGPDGAGSPLPSDEESLQTGPGAVAHTCNPALRRPKWEDRLRPGVPDQPWQNSKIPIS

SEQ ID NO: 771104 - protein, 175 aa, Homo sapiens
MSARSPTTPLNYFLGGCAGGLTLGARTHNYGIGAAACVYFGIAASLVKMGRLEGWEVYCKTKDVSPVNCRDLQPAKNAVQNIKILVSCVMKKTTKQNTHNHPHGKHIVRAARHKRRAHQTADPLGRKRWTHLEPHRLSDDNHAGTNRQGTATKETHTNQNRNKTGVTMRVSSPQT

SEQ ID NO: 771105 - protein, 37 aa, Homo sapiens
ELNVRAMDRIRWKELSIWPETVPRYSGKTGRRTEWAA

SEQ ID NO: 771106 - protein, 50 aa, Homo sapiens
LSWVSSSCCCCSRCCVERQGARRPGPVRARGPLRVLAAAARPSGLAPMAV

SEQ ID NO: 771107 - protein, 356 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771108 - protein, 356 aa, Homo sapiens; identical to SEQ ID NO: 771107

SEQ ID NO: 771109 - protein, 356 aa, Homo sapiens; identical to SEQ ID NO: 771107

SEQ ID NO: 771110 - protein, 271 aa, Homo sapiens
MMEQKMKEEQERRKKKEMEERMSLEETKEQILKLEEKLLALQEEKHQLFLQLKKVLHEEEQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771111 - protein, 387 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGEDYKKPPDGTGLLGGHSLPFQHHEALLPFSGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771112 - protein, 320 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSVSMAPWEVRVRDMLRGASVCLRP

SEQ ID NO: 771113 - protein, 195 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAWDCSAPTSLWAHTASL

SEQ ID NO: 771114 - protein, 242 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRGE

SEQ ID NO: 771115 - protein, 264 aa, Homo sapiens
MMEQKMKEEQERRKKKEMEERMSLEETKEQQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSALHPAPGLLASPQLPVQMQPAGKSGFAATSQPGPRLPFIQHSQNPRFYHK

SEQ ID NO: 771116 - protein, 164 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGED

SEQ ID NO: 771117 - protein, 411 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGEDYKKPPDGTGLLGGHSLPFQHHEALLPFSGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSPALRAQCTRPGRRAVHAPLELALLSAPRLPLCESAARQESRALQLPANLALGSPSSNTARTRDSTTSDHQIISSTPHPPPHRG

SEQ ID NO: 771118 - protein, 218 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGALGGHTRPRTLHGSCTEPHTLFGPQCLRTPHYVGVCAAFSRDTRTLDITSGVLVGG

SEQ ID NO: 771119 - protein, 164 aa, Homo sapiens; identical to SEQ ID NO: 771116

SEQ ID NO: 771120 - protein, 289 aa, Homo sapiens
MMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771121 - protein, 291 aa, Homo sapiens
AAQNMDAESRQEEEEVDKMMEQKMKEEQERRKKKEMEERMSLEETKEQQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771122 - protein, 350 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKVRMVIEFTCQNPYTRDPEKQD

SEQ ID NO: 771123 - protein, 347 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSALHPAPGLLASPQLPVQMQPAGKSGFAATSQPGPRLPFIQHSQNPRFYHK

SEQ ID NO: 771124 - protein, 311 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSLCAPCVDNRAELI

SEQ ID NO: 771125 - protein, 242 aa, Homo sapiens; identical to SEQ ID NO: 771114

SEQ ID NO: 771126 - protein, 385 aa, Homo sapiens
LIGTRKGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGDNIHAGALALRSSPPCFILISHAPLPHLGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 771127 - protein, 953 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771128 - protein, 274 aa, Homo sapiens
WLCFLLGLGVMPKNLPLVPGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSAKQTELDADRRDAIHSTRQSPSISVTTTTQVPTREAPRAPGIAKSEQQQHTETTILVAPPPTPRNPQGREKRQQASREPGDSADTGHGPP

SEQ ID NO: 771129 - protein, 573 aa, Homo sapiens
MSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771130 - protein, 499 aa, Homo sapiens
MSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771131 - protein, 499 aa, Homo sapiens; identical to SEQ ID NO: 771130

SEQ ID NO: 771132 - protein, 574 aa, Homo sapiens
WLCFLLGLGVMPKNLPLVPGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771133 - protein, 662 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPRKMTRDTEEGVSKRGKRVAGVVVEIYWVSGLSSYRARDYYVFEGILVQAKYGKVVGRRIGLGPQMSGSPDSSLFWLRPWMSDRHVQIGRLNMPEPAGINREVHGTMHDSAWRNAHRMNLVGPENPAEKEKNSERGRQEKSTTLGTICIILRGCAYTRAETKTEGSDTGDNRTRDDNAADHKERKGGHLRPEQRAQNTNRGPREAHGYSTGAPPGSHLEQRPPRAGRQAPQDAGGHAARLSQKPPRAKEKTTAATRQSPQPAQQLHTPRYSKHEQNSNA

SEQ ID NO: 771134 - protein, 204 aa, Homo sapiens
MEDRYRADFPRPDHRFHDFDHRDRGQYQDHAIDRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771135 - protein, 187 aa, Homo sapiens
MCSRAWCCLNGIFSFCRREGSRPMMGDHRDGQHYGDDRHGHGGPPERHGRDSRDGWGGYGSDKRLSEGRGLPPPPRGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771136 - protein, 388 aa, Homo sapiens [sequence omitted]

SEQ ID NO: 771137 - protein, 141 aa, Homo sapiens
MGLAAFLHGHCDCLATWDSGQLDSDFHLPEGGRDWGEHNQRLEEHQARAWQGAMDAGAASREHARWQGGERGLSGPSGPGHMASRGGVAGRGGFAQGGHSQGHVVPGGGLEGGGVASQDRGSRVPHPHPHPPPYPHFTRRY

SEQ ID NO: 771138 - protein, 222 aa, Homo sapiens [sequence omitted]

SEQ ID NO: 771139 - protein, 219 aa, Homo sapiens [sequence omitted]

SEQ ID NO: 771140 - protein, 953 aa, Homo sapiens; identical to SEQ ID NO: 771127

SEQ ID NO: 771141 - protein, 825 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSFKEEKDIKPIIKDEKGRVGSGSGRNLWVSGLSSTTRATDLKNLFSKYGKVVGAKVVTNARSPGARCYGFVTMSTSDEATKCISHLHRTELHGRMISVEKAKNEPAGKKLSDRKECEVKKEKLSSVDRHHSVEIKIEKTVIKKEEKIEKKEEKKPEDIKKEEKDQDELKPGPTNRSRVTKSGSRGMERTVVMDKSKGEPVISVKTTSRSKERSSKSQDRKSESKEKRDILSFDKIKEQRERERQRQREREIRETERRREREQREREQRLEAFHERKEKARLQRERLQLECQRQRLERERMERERLERERMRVERERRKEQERIHREREELRRQQEQLRYEQERRPGRRPYDLDRRDDAYWPEGKRVAMEDRYRADFPRPDHRFHDFDHRDRGQYQDHAIDRREGSRPMMGDHRDGQVSRAPMPSPGATVLLCRHSGPFLARRP

SEQ ID NO: 771142 - protein, 573 aa, Homo sapiens; identical to SEQ ID NO: 771129

SEQ ID NO: 771143 - protein, 113 aa, Homo sapiens
MLGLEEWNLCNSGLVNGNTSLTVNHIPDRHGQVKTNSSRWPDSTCLQYSIEAHRTLEIKGNITNTAETQGLVVVCLREKHPEETISNISLLLEYILSSDGQSYNWVYSRNFFL

SEQ ID NO: 771144 - protein, 183 aa, Homo sapiens
VSAEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKE

SEQ ID NO: 771145 - protein, 259 aa, Homo sapiens
GSRPWLRGSGESGLQAGSLPLPGAGAGPQPACVRDKRTPSLSSLESPSAAGWRKGPWAQPIVSGVYGHGSGRGKGQSSLHPQFIPGPGPCRHALGSCGKTVRAPGQTSSPGIWVPEMAEVAEWGGMAQLGALASGKELSTVHLQCVRFSWETRAQLVVSWGKWVILPWEEPPGPLGKCTRCLQRPGLGSWVGAGGPSVLRVPAPGPSLPWAKPARASLSSACPAGHLWASLETSGVGCGGVILPWLGIPLVAVPLPAAP

SEQ ID NO: 771146 - protein, 158 aa, Homo sapiens
RKGAWAGDGVKCRQEIRLIKKRLHLPRTTLSPFAAGALPAANPTWNLAPCDVSLILGHGSPGSPFQPGSLRWCWLVSPVCWGQLRPASAPAGLPGQPRGDGRAWRSSLDDPSHHFNIIRNLTGFCKKAQSPCFLAFLFKSTHLHLLPKALEVLQTASF

SEQ ID NO: 771147 - protein, 89 aa, Homo sapiens
EGLKAVVAKLGLRRTARATTSLSLRVPSFPVSERLSRRTLWTCSDGGRELVWNSPLFPRFPRLQIRRGRFAPVAWPPCPLSLAVLDRKC

SEQ ID NO: 771148 - protein, 174 aa, Homo sapiens
MSRTGLPVCPWAAVSPVARRRGEQNPAASGAAWGWVLPAVCLCALWVCVCVSVCLCVCARTRVCVPTTVSYVSVSLSLPSRSFRRPLFLSLSVCVCMRLGTHVPCAPEAGFLARRPFFWSASPRVSAWVLWPVGNRFPGGSGLGVCEGLGNVGICVGAAGVFIPSPPGAASLLA

SEQ ID NO: 771149 - protein, 42 aa, Homo sapiens
MPGAGCGSGLAPLSISPAGNKSRTTAGKQDQRPEIPHFGRTM

SEQ ID NO: 771150 - protein, 233 aa, Homo sapiens
AGWYAPGLIQLRREAARAGSFLFPKCRQSPRSHGQPFRQLRSHWQAPRQDGRPRREEDDVPPEEKRLRLGLEGGSAQPEDCEDGKDAPRPGREETGTQTGGDGRGDLLCLPYSLVEGQDYKSENSTLLPGAKNSLQDSVSRSILLNRLDFETTFASFSASLVSVINHREWFLPETDLAGELTGFEGNKFSRALAQFLSLGPYSQPLVHGVRAVFCPLKKTRPTWWTDPGHSGW

SEQ ID NO: 771151 - protein, 197 aa, Homo sapiens
MPPLWPCGACALCLGALGTGSLDAVMVLVEHADAWSPCGCSEMHVMLVVPSILEPPGVGLLLPETWLQGGCHSRLPAPVCTMSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPV

SEQ ID NO: 771152 - protein, 70 aa, Homo sapiens
SLHAGSHLPALQPYLQLTAISKYLINSRCQTRSGSFLRDQYGGAPSEQAGGEEVGMGREETCSWNLVSWV

SEQ ID NO: 771153 - protein, 52 aa, Homo sapiens
SCVSSSPEGPSCTCSIPEGPSRTCSIPEGPSHTCSIPEGLSCVSFSPKGLSR

SEQ ID NO: 771154 - protein, 104 aa, Homo sapiens
CGNTAWLSAAFGQGQLPGTAGLRGHDPGPGNTVRPGHAARPQRGGLLRRPTTFLRVGSQGRANSMPAVSSGGPSLPGTLPVPASCLGQAGSSLTALVPGLLPRA

SEQ ID NO: 771155 - protein, 122 aa, Homo sapiens
AGVLYTSSHSTLTTTPRNKINTTTLLEEEAETCQVVRDKPSRELHPSLNSTGNPKKGNLKSFLVGELGAFHQQGAVVKDTWRIPAPWTGCSPSTFLSVTWGDGQARWLTPVIPALWEAEAGG

SEQ ID NO: 771156 - protein, 71 aa, Homo sapiens
KTATSPRSCLPFLRKPRADDWPYGYKTHNPLRGTPTRASLKDYGVQCSTEWDITFCWEDPLPNQGSIWSES

SEQ ID NO: 771157 - protein, 148 aa, Homo sapiens
MWLGRRALCALVLLLACASLGLLYASTRDAPGLRVPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYP

SEQ ID NO: 771158 - protein, 267 aa, Homo sapiens
MLTYILSFLPLSDQKEASLVSWAWYRAAQNALREQPGLTSLDLSGCSELTDGALLAVSRGLRHLRRLSLGKLQRLTDAGCTALGGLQELQSLDMAEGGTGPGPGLYARGSIPAGLPQPGPLLFIEGCLSALHDPSTGLSLRVLDLSSCVALTTGPCRPSAPTSPPLSPAPGVVQRSSVTGGFGGPGGRPVPGDPGVGTLEVLRGTRVAPGNQTAPPAPPKVLCRSNSKGKTSGTEPEKGKGLFPQAGPELEHQASGTKGRRQKHTGP

SEQ ID NO: 771159 - protein, 208 aa, Homo sapiens
MIWLRNRRCLEPLQGTPKWVPVLGELQKTLQKGEYLPLRPLPMFESNFVQVTHQGGPVFVNHRTNRLAMGVAASLPGLVLPDILLIGQPAEDRDCSGLVLTRMIPWTSSTSAVHDLSAWRLKLRLVSGRQYYLALDAPDNEVGFLFHCWVRLINLLQEPAPTWTPRTTRTAPLDMPLAEAPASTWHLQDQPISRHAVQGLLSATFRID

SEQ ID NO: 771160 - protein, 135 aa, Homo sapiens
LAGGRAAGKDMPKASFGDGGSSCACMHSDTLSLKKAGTHGPSRSLGCGTGGTPHPQQYHLALLQFPRMEDVTTLPPGSSATLSSSSSSSAEADESQVPSPTWERGRPQAWCWAVRWLPAFLLHFACSIILKETLG

SEQ ID NO: 771161 - protein, 143 aa, Homo sapiens [sequence omitted]

SEQ ID NO: 771162 - protein, 88 aa, Homo sapiens
DACLSQRWVVGIHMKQGIASHGQRSMDAAVLRVAAPPDAGCGFHHTQEQLALEVSHVTCLPGRPLAELSMVVGCQQGVCFAKSFADLP

SEQ ID NO: 771163 - protein, 122 aa, Homo sapiens
SLDLSGIDSCEMSDSGSQVPDSLPSTPSPVESTKSFSVHSDRESSITNDMGFSDDFSLLESQERCEEELLQLLTHILNYVMCKGLEKSDDDTWIERGQVFSALSKPGISSELLRPSDEIKLT

SEQ ID NO: 771164 - protein, 377 aa, Homo sapiens
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKLESTESILQEATSSMSLMTQFEQEVSNLQDIMHDIQNNEEVLTQRMQSLNEKFQNITDFWKRSLEEMNINTDIFKSEAKHIHSQVTVQINSAEQEIKLLTERLKDLEDSTLRNIRTVKRQEEEDLLRVEEQLGSDTKAIEKLEEEQHALFARDEDLTNKLSDYEPKVEECKTHLPTIESAIHSVLRVSQDLIETEKKMEDLTMQMFNMEDDMLKAVSEIMEMQKTLEGIQYDNSILKMQNELDILKEKVHDFIAYSSTGEKGTLKEYNIENKGIGGDF

SEQ ID NO: 771165 - protein, 244 aa, Homo sapiens
MEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 771166 - protein, 350 aa, Homo sapiens
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKWQKSEAIMEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 771167 - protein, 244 aa, Homo sapiens; identical to SEQ ID NO: 771165

SEQ ID NO: 771168 - protein, 219 aa, Homo sapiens
MEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKPSIRGDPL

SEQ ID NO: 771169 - protein, 106 aa, Homo sapiens
YRLECSQKNPNLPDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 771170 - protein, 244 aa, Homo sapiens; identical to SEQ ID NO: 771165

SEQ ID NO: 771171 - protein, 350 aa, Homo sapiens; identical to SEQ ID NO: 771166

SEQ ID NO: 771172 - protein, 244 aa, Homo sapiens; identical to SEQ ID NO: 771165

SEQ ID NO: 771173 - protein, 244 aa, Homo sapiens; identical to SEQ ID NO: 771165

SEQ ID NO: 771174 - protein, 111 aa, Homo sapiens
RSRLSLHTSLQAEGAGFGLGRPRKGLPQCSGGLKGSSSAAKVGAQAEEAPRASEGCEGCPHAVTSHLGLELQLCPEVWAPAGLVERTTLATPPTSASFFSAATPEGPPLAS

SEQ ID NO: 771175 - protein, 86 aa, Homo sapiens
DVTSGVHSRSAVRWGPGRVAGKDLEALQIHLCILASDFTTEGQPSLEASLINVTRKPLPQQTKGMEEETYNKRHLKKKEKLVFRKH

SEQ ID NO: 771176 - protein, 103 aa, Homo sapiens
MAPGRSRRVDRLSKPRALMAGAREKALRRGHSPGGAASTLLHSAGHLGLSKPAGCCTFWDRESVSWVNPAHGRGGAARSCGTGYPAGCWLQRLHLPLGQPPGP

SEQ ID NO: 771177 - protein, 171 aa, Homo sapiens
ITLYEDRGFQGRHYECSSDHPNLQPYLSRCNSVRVDSGCWVLYEQPNYSGLQEFLRRGDYADHQQWMGLSDSVRSCRLIPHASSHRLRIYEREDYRGQMVEITEDCSSLHDRFHLSEIHSFNVLEGSWVLYELPNYQGRQYLLRPGDCRWCQDWGATDARVGSLRRAVELY

SEQ ID NO: 771178 - protein, 333 aa, Homo sapiens
REVGWGDYKPLTAPQAARGTSATTALQPGVPDFTGSRACGQAPRASGFVEGTLGILSTVQVLGGPPWLRRTLPKLGRPKEAPVARMSTQSTHPLKPEAPRLPPGIPESHCSCRVWTHNSELAVSLAVCLRVARHSTRGTTVEADSVGESEGVKVHSFVQSCGPSAPTVALDDRILASFLVIAKCHTMHVPCGMRSDGGSSSRIVSRSLIRVSASWVQRQETSLAVKSSDLLAITVHGGLIIAPHCNLSVSRVTRAFRQQGRGPILLWRYLHHLGSQPAVRRAALMCEDALVPFYERFSFHAVGPCAITVGSLTFMELHCSLRGHPFLRRNSGC

SEQ ID NO: 771179 - protein, 292 aa, Homo sapiens
REVGWGDYKPLTAPQAARGTSATTALQPGVPDFTGSRACGQAPRASGFVEGTLGILSTVQVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 771180 - protein, 692 aa, Homo sapiens
MGSVGGEGRITEGDMRRGRDGGPLHGCPKKPATFPHHRKKGSKQTNLDFSPINPKIQRDLKSLVGGSQLEGGRGSLTAEGTDWARFSQSPPHAPLLQSSPPRAGSGSWGRIGYEETILPPLELGVRGWGPSKGRRAAKLQIGLGSVGVRATGGVRELGRGARAARARSGAAVPTGGRPASLHRQERTGFQGERAASPGKDIWSLKPPPGPCPDPEKKQARGAAPHSSEGRSRGPAPGRGPGPRSQAGSRVGLGRLWAGQAAEVGIQGSLGRSPHETRGWRRVVGGRRYPSAPLTLCCLSPLPARGAPSGTMLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 771181 - protein, 382 aa, Homo sapiens
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 771182 - protein, 197 aa, Homo sapiens
CYLTLTQAMKMGLGGNPYGPAGTGKTESVKALGGLLGRQVLVFNCDEGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDYGFS

SEQ ID NO: 771183 - protein, 94 aa, Homo sapiens
RIEWNRHRMELNTIIEWSRMESSSNGKEWNHRIESNGIIIEWNRMVSTSNGKKRNYRMESKRIFERTRMESSNGMEWNNPWTGRQSSSNGIEWN

SEQ ID NO: 771184 - protein, 38 aa, Homo sapiens
MVNSSQRVPTNETMNGTKRISRTISDRIWTLDPQNRPT

SEQ ID NO: 771185 - protein, 542 aa, Homo sapiens
GATPRTVNRRALRELGSCEAAGGVGVRGARAMATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 771186 - protein, 238 aa, Homo sapiens
GATPRTVNRRALRELGSCEAAGGVGVRGARAMATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQGKLRMKQSKK

SEQ ID NO: 771187 - protein, 524 aa, Homo sapiens
GATPRTVNRRALRELGSCEAAGGVGVRGARAMATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 771188 - protein, 385 aa, Homo sapiens
GATPRTVNRRALRELGSCEAAGGVGVRGARAMATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKAFRFPK

SEQ ID NO: 771189 - protein, 502 aa, Homo sapiens
MRGLCEFYWQEFGIKGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 771190 - protein, 209 aa, Homo sapiens
DLLLGVQQEGDCVHLARLRPERGADFSRRRGSVCPGGGRTKDGRRRKRAAAWAEAGPQLRRRRRRLGLGGGHEPPGAEWWPPGLTRRGKRPGPAILTAHRGPRGNLRRLRPLCPAESPPPGAAGRSGRARGEEASERGTMSRGPAALRREGERDPGPAERTYGLWRAPAAAFKPPERRKGVRKGPAQAAGRAAADAPLEGVRLSADPPP

SEQ ID NO: 771191 - protein, 117 aa, Homo sapiens
GEVAHQLQGSLFEPQITGLGVPKVMAWCLALHHPSPITQAPPGAELGQGGFQRRQMGQEQGDHSTWRPELLRDSRRRSSPEPAGTCWVLTGSRRGSAAGNQVIETFNSGGGGDGWRQ

SEQ ID NO: 771192 - protein, 166 aa, Homo sapiens
LLCSTEPGTESCSVNTCWMVGWVTGQWLWATCESSVGCQTQPAELNSTWKPLCKWQCPMGFSLKMGAVATLPAPRRDLAPLEMGLSSQPASTHFLVPSTKRFEDMIAPFRLNDGFKDEATVNEMRRDCPWKISDEEITKNRVKSLRQVRLNEIVLDYSRDAALIVM

SEQ ID NO: 771193 - protein, 1038 aa, Homo sapiens
PSLDTQATMAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIGVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 771194 - protein, 1029 aa, Homo sapiens
PSLDTQATMAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIGVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 771195 - protein, 224 aa, Homo sapiens
DIYWLFDDVYGLLALLRLEDGGGLLLLSPGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 771196 - protein, 86 aa, Homo sapiens
GRWLCSDPPPPPAVDPKALVKEEQATTIFQSEQGKKTIDIYWLFDDGGSDPLGSALLPGGGGVVVVFLPSPSWPALKGDRGSWAQQ

SEQ ID NO: 771197 - protein, 144 aa, Homo sapiens
LLCSTEPGTESCSVNTCWMVGWVTGQWLWATCESSVGCQTQPAELNSTWKPLCKWQCPMGFSLKMGAVATLPAPRRDLAPLEMGLSSQPASTHFLVPSTKRFEDMIAPFRLNDGFKDEATVNEMRRDCPGITGVSHGAQLQIVI

SEQ ID NO: 771198 - protein, 510 aa, Homo sapiens
ELAWPLRKDDSKFVKRSIFFISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 771199 - protein, 86 aa, Homo sapiens
HMKKRCPGEFKRHQHQLLFIDRTEHFAHREEGEVPQLAVHGLAGDPVPGPQTSSHPDPRKPGKRAHLLLPVTPGFDIPVHSSECVG

SEQ ID NO: 771200 - protein, 212 aa, Homo sapiens
LGPHADLFRKHEIDGKALLLLRSDMMMKYMGLKLGPALKLSYHIDRLKQGKFLNQESTATATTGETFVLGNSLARSLEPHSDSMDSASNPTNLVSTSQRHRPLLSSCGLPPSTASAVRRLCSRGSDRYLESRDASRLSGRDPSSWTVEDVMQFVREADPQLGPHADLFRKHEIDGKALLLLRSDMMMKYMGLKLGPALKLSYHIDRLKQGKF

SEQ ID NO: 771201 - protein, 109 aa, Homo sapiens
CCLLHSNRYLGASTLAVLLSSNSGFTVFQVKPLSWGIVWPAPWNHTQTQWTLPQIPPTLSAPPKGTGPCFHPVASHQALPQLCAGYAPGVSLPESWPSFPPSLFPSLPS

SEQ ID NO: 771202 - protein, 143 aa, Homo sapiens [sequence omitted]

SEQ ID NO: 771203 - protein, 216 aa, Homo sapiens
PSFRNKLAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDSLGEAVDMSIKGMYTLLARCEELERALQPVQGLARQVRDIRRTLEVLEALCK

SEQ ID NO: 771204 - protein, 319 aa, Homo sapiens
PTWSMESSRGRPGPETDLLAVAEHQALVFGGGPGRTSSEPPAGLRVSGEEETENVGGANRHPRTSPKTSSCGVVHRPEREALENEPGPQGTLSGAGSRRGAPGAEHEPSLSSRHKNPAPPEGKPSSGRDCRRGGPGGGMDVEQQEEEDNDEEAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDLQGVLVGSAH

SEQ ID NO: 771205 - protein, 361 aa, Homo sapiens
PTWSMESSRGRPGPETDLLAVAEHQALVFGGGPGRTSSEPPAGLRVSGEEETENVGGANRHPRTSPKTSSCGVVHRPEREALENEPGPQGTLSGAGSRRGAPGAEHEPSLSSRHKNPAPPEGKPSSGRDCRRGGPGGGMDVEQQEEEDNDEEAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDSLGEAVDMSIKGMYTLLARCEELERALQPVQGLARQVRDIRRTLEVLEALCK

SEQ ID NO: 771206 - protein, 350 aa, Homo sapiens [sequence omitted]

SEQ ID NO: 771207 - protein, 850 aa, Homo sapiens
MVASARVQKLVRRYKLAIATALAILLLQGLKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLEVGTDWDPKERLFRNFGGLLGPLDEPVAVQRWARGPNLTATVVWIDPTYVVATSYDITVDTETEVTQYKPPLSRPLRPGPWTVRLLQFWEPLGETRFLVLPLTFNRKLPLRKDDASWLHAGPPHNEYMEQSFQGLSSILNLPQPELAEEAAQRHTQLTGPALEAWTDRELSSFWSVAGLCAIGPSPCPSLEPCRLTSWSSLSPDPKSELGPVKADGRLR

SEQ ID NO: 771208 - protein, 865 aa, Homo sapiens [sequence omitted]

SEQ ID NO: 771209 - protein, 765 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLEVGTDWDPKERLFRNFGGLLGPLDEPVAVQRWARGPNLTATVVWIDPTYVVATSYDITVDTETEVTQYKPPLSRPLRPGPWTVRLLQFWEPLGETRFLVLPLTFNRKLPLRKGKRAVLK

SEQ ID NO: 771210 - protein, 511 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQPLRPMQSFQVCTGSEVT

SEQ ID NO: 771211 - protein, 865 aa, Homo sapiens [sequence omitted]

SEQ ID NO: 771212 - protein, 128 aa, Homo sapiens
MGLASTESVAGGVLTACSAPTDDASWLHAGPPHNEYMEQSFQGLSSILNLPQPELAEEAAQRHTQLTGPALEAWTDRELSSFWSVAGLCAIGPSPCPSLEPCRLTSWSSLSPDPKSELGPVKADGRLR

SEQ ID NO: 771213 - protein, 778 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLEVGTDWDPKERLFRNFGGLLGPLDEPVAVQRWARGPNLTATVVWIDPTYVVATSYDITVDTETEVTQYKPPLSRPLRPGPWTVRLLQFWEPLGETRFLVLPLTFNRKLPLRKDDASWLHAGPPHNEYMEAGL

SEQ ID NO: 771214 - protein, 502 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 771215 - protein, 404 aa, Homo sapiens
RRREVGLQHGGCGTGGGYGDGLARSGQSWRWWRSLSLGAVGSSAGTEPGRPAGASTFRLLRRRQQRHSGSKWLLRSWVQIFMGLSVTLMMSHLRQETNSKHQLKLVYLLASPCLIVCRLSEKYSMTSLWKRKPNGFITLPQLGNCEKMSLSSKVSLPPIPAVSNIKSLSFPKLDSDDSNQKTAKLASTFHSTSCLRNGTFQNSLKPSTQSSASELNGHHTLGLSALNLDSGTEMPALTSSQMPSLSVLSVCTEESSPPNTGPTVTPPNFSVSQVPNMPSCPQAYSELQMLSPSERQCVETVVNMGYSYECVLRAMKKKGENIEQILDYLFAHGQLCEKGFDPLLVEEALEMHQCSEEKMMEFLQLMSKFKEMGFELKDIKEVLLLHNNDQDNALEDLMARAGAS

SEQ ID NO: 771216 - protein, 502 aa, Homo sapiens; identical to SEQ ID NO: 771214

SEQ ID NO: 771217 - protein, 502 aa, Homo sapiens; identical to SEQ ID NO: 771214

SEQ ID NO: 771218 - protein, 77 aa, Homo sapiens
SVGGGQLSGRSLPWVGGAGEAEYVGPGSALPHGAAWRGAGSWVELRGIKLWPCASSSLGSTLFWEREYQHKVGERRI

SEQ ID NO: 771219 - protein, 104 aa, Homo sapiens
SVGGGQLSGRSLPWVGGAGEAEYVGPGSALPHGAAWRGAGSWVELRGIKLWPCASSSLGSTLFWEREYQQMNLAVLSRLECSGTISAHCNLWLPGSSDSPASAP

SEQ ID NO: 771220 - protein, 75 aa, Homo sapiens
REHQLRLSPLQGRRDSAAGGGGAVALGRLKRDGCKGEELRVLSIRRKTRSAVEEHCTGVRKWSLGVTLHLTSLGL

SEQ ID NO: 771221 - protein, 77 aa, Homo sapiens
MPKCPKCNKEVYFAERVTSLGKDWHRPCLKCEKCGKTLTSGGHAEHEGKPYCNHPCYAAMFGPKGFGRGGAESHTFK

SEQ ID NO: 771222 - protein, 140 aa, Homo sapiens
MAQSKSESLKTRDADSAALSLRPKARSLWEAIGASPRVQRWKNLESGVQGQKERKSSILHSTGRKRGSRLSKHAAYLHSSTCCVLASLAANSMVPTHTEGGSSSPTPLTPMSVSVSNTLTDTQGNNASSAIQVSLNLVDT

SEQ ID NO: 771223 - protein, 33 aa, Homo sapiens
FSYKAAGLWEVHLIPVLESWFAASRTSSGAEFA

SEQ ID NO: 771224 - protein, 497 aa, Homo sapiens
EFREQKASERASELPAVGERGDRKSERGEGARGEKVTVKCAAPLTGALSPAPRVMATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 771225 - protein, 383 aa, Homo sapiens
RRASQRVSESEKEGEEEKESEGGAGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 771226 - protein, 102 aa, Homo sapiens
MGVTVNLMGILGKRFWRSAYKRVLVIGNNGPFPKSGSDGVMSGKIYSQARILSIHKKLRKIRCQNTQHNTGIFEVPYRSKIPGTMNTRPEGVNPFNHFKHGR

SEQ ID NO: 771227 - protein, 122 aa, Homo sapiens
MLIYMLMYMLIVMFIFYHDKNILKSYINSCRSPVENSPMTSHSIILWDGSTMLDHKALHNAAPTSLSPWPRLLPPTPFSSCQAPQPPHGALQQLCELPACWQPSQQRALVCPLLSLYSGHYL

SEQ ID NO: 771228 - protein, 71 aa, Homo sapiens [sequence omitted]

SEQ ID NO: 771229 - protein, 418 aa, Homo sapiens
LRSRSAPSLADLPFPSRLPTPGPWPQHPVRCRLRAGKSSRSPRRPCRSAGGQRAARHPQPAACSPQPAARSQIAGSDRTRLDRRPQPGAMLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 771230 - protein, 167 aa, Homo sapiens
MYCRGAAAIILTYDVNHRQSLVELEDRFLGLTDTASKDCLFAIVGNKVDLTEEGALAGQEKEECSPNMDAGDRVSPRAPKQVQLEDAVALYKKILKYKMLDEQDVPAAEQMCFETSAKTGYNVDLLFETLFDLVVPMILQQRAERPSHTVDISSHKPPKRTRSGCCA

SEQ ID NO: 771231 - protein, 234 aa, Homo sapiens
MRKPDSKIVLLGDMNVGKTSLLQRYMERRFPDTVSTVGGAFYLKQWRSYNISIWDTAGREQFHGLGSMYCRGAAAIILTYDVNHRQSLVELEDRFLGLTDTASKDCLFAIVGNKVDLTEEGALAGQEKEECSPNMDAGDRVSPRAPKQVQLEDAVALYKKILKYKMLDEQDVPAAEQMCFETSAKTGYNVDLLFETLFDLVVPMILQQRAERPSHTVDISSHKPPKRTRSGCCA

SEQ ID NO: 771232 - protein, 142 aa, Homo sapiens
MRKPDSKIVLLGDMNVGKTSLLQRYMERRFPDTVSTVGGAFYLKQWRSYNISIWDTAGREQFHGLGSMYCRGAAAIILTYDVNHRQSLVELEDRFLGRHTQWIYPVISHPRGPDLGVVPDFRGPPGLRLCMLGRGLTRQAVI

SEQ ID NO: 771233 - protein, 726 aa, Homo sapiens
TCQEHVPPAVAGALGAAAMGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 771234 - protein, 324 aa, Homo sapiens
MDQWGVYFNPVLVSFCQSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLFLVRPSPCLLRFVLFFPSALFSSCQLHAGMHVGIWSKCFLPCEFHLLFVLFKSLIPVTTGESKPSLAWASIFLNCYSCKVMLVVRGKRQERCLGSQAGGRSCHFSLQALLPSDISVT

SEQ ID NO: 771235 - protein, 141 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 771236 - protein, 141 aa, Homo sapiens; identical to SEQ ID NO: 771235

SEQ ID NO: 771237 - protein, 141 aa, Homo sapiens; identical to SEQ ID NO: 771235

SEQ ID NO: 771238 - protein, 141 aa, Homo sapiens; identical to SEQ ID NO: 771235

SEQ ID NO: 771239 - protein, 141 aa, Homo sapiens; identical to SEQ ID NO: 771235

SEQ ID NO: 771240 - protein, 119 aa, Homo sapiens
MRGLALASMGKGETETHRCVTMARCPALPQPQLGAARCPRRGKSVWGGMRTHSLGSCWEATWTPASLCASVSTSPESRALFLSDLIPEESVLSGVSVWLPGWAPARAWSVLVRPSPTRA

SEQ ID NO: 771241 - protein, 123 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARSEVAPSPPPPSSQPGQNDP

SEQ ID NO: 771242 - protein, 146 aa, Homo sapiens
GRVGRRTRGSTHASGDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 771243 - protein, 106 aa, Homo sapiens
LHPDTGSERPRGSCCARLEALALPVYPAAAVGAVFGLTTCISAHVREKPDDPLNYFLGGCAGGLTLGARTHNYGIGAAACVYFGIAASLVKMGRLEGWEVFAKPKV

SEQ ID NO: 771244 - protein, 77 aa, Homo sapiens
ADAGGEAKHGPDSSCSERVLSNLSHYFLGGCAGGLTLGARTHNYGIGAAACVYFGIAASLVKMGRLEGWEVFAKPKV

SEQ ID NO: 771245 - protein, 141 aa, Homo sapiens; identical to SEQ ID NO: 771235

SEQ ID NO: 771246 - protein, 141 aa, Homo sapiens; identical to SEQ ID NO: 771235

SEQ ID NO: 771247 - protein, 113 aa, Homo sapiens
MFPSGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 771248 - protein, 117 aa, Homo sapiens
TASLLCLAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 771249 - protein, 80 aa, Homo sapiens
PGRAIPGEVQKKVTKIIFGFKHPTMEMLKPMSFKSFSSPSRGPSAYMGHRGGHLMYSCLVPTSALPPGGHRHHCCCLSTV

SEQ ID NO: 771250 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 771251 - protein, 124 aa, Homo sapiens [sequence omitted]

SEQ ID NO: 771252 - protein, 235 aa, Homo sapiens
HTRIHSGEKPYKCNECSKTFRLRSYLASHRRVHSGEKPYKCNECSKTFSQRSYLHCHRRLHSGEKPYKCNECGKTFSHKPSLVHHRRLHTGEKSYKCTVCDKAFVRNSYLARHTRIHTAEKPYKCNECGKAFNQQSQLSLHHRIHAGEKLYKCETCDKVFSRKSHLKRHRRIHPGKKPYKCKVCDKTFGSDSHLKQHTGLHTGEKPYKCNECGKAFSKQSTLIHHQAVHGVGKLD

SEQ ID NO: 771253 - protein, 75 aa, Homo sapiens
CRCSARYVNLYGASVCTIPQCCRQTSWIVFGTSVSQSSPADKRAWGGATDGGKVPAGRGGAADEGRGLPVAVGSS

SEQ ID NO: 771254 - protein, 189 aa, Homo sapiens
MEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 771255 - protein, 168 aa, Homo sapiens
MEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTR

SEQ ID NO: 771256 - protein, 277 aa, Homo sapiens
VRAQTVLACAEQGGVSERNAQLKREVGSRPGHLPGDHMARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLS

SEQ ID NO: 771257 - protein, 272 aa, Homo sapiens
GDPQVVSPPHAERNAQLKREVGSRPGHLPGDHMARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLS

SEQ ID NO: 771258 - protein, 148 aa, Homo sapiens
MQTFPVAGALDPAILDTSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 771259 - protein, 148 aa, Homo sapiens; identical to SEQ ID NO: 771258

SEQ ID NO: 771260 - protein, 126 aa, Homo sapiens
PGRGRPTACPPRFTPQAPELRTTSPRVRSVCHSQRPMLKPSTSSAPSVSSDSVGVGGAGGVQVWRGGKKVQSLSLSLSLSLFLDSPGTQKRPEACLLTFFKGRPPGDMGTWGRSLHLSVPVRKAVG

SEQ ID NO: 771261 - protein, 54 aa, Homo sapiens
MPLRAAARELRWVPKRGIGKRDLTAAAAATRTGPVEAARAYASRGNDARQAAAA

SEQ ID NO: 771262 - protein, 338 aa, Homo sapiens
GGGFSESREGSSRVSAVQTGPSAKNLLSGFSQCLPGWMFGRVYAWPCGIAVADSQLSEGSITPSVSDGSWWRVLSRDVILTGPRAGCPGDRSLTSHQTMCLVNVTQEPEPLAPAPNYSQANNLLSNSPANSAWHRVQALDVDGAGLHPFSCPHCWSNRVKAMASNCTKWTTCCIYLFTGIPSDKYLSHPLLLTVDSRASTQGHVAGHRCNATALGLRPWPLNRTRIDDKGYAPVLSHGLVSISLSYVKLARRRTPQQLLGELTRQLMPFGPPSRRSGIPLTGRQPTHVSPYGNVGFLRHGRHESHGQAPPAGRQPLQVGPGVSETHTPFERRALQQDT

SEQ ID NO: 771263 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNAAIDLSNKASLAFLQKHLGLHKDFDQWDCLIEGDDENLIPGTNINTTNQHIMLQNSSGIEKYN

SEQ ID NO: 771264 - protein, 441 aa, Homo sapiens; identical to SEQ ID NO: 771263

SEQ ID NO: 771265 - protein, 450 aa, Homo sapiens
RQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTMIIAIGGVIVASVLVFIVLLMIRYKVYGDGDSRRVKGSRSLPRVSHVCSQTNGAGTGAAQAPALPAQDHYEALREVESQAAPAVAVEAKAMEAETASAEPEVVLGRSLGGSATSLCLLPSEETSGEESRAAVGPRRSRSGALEPPTSAPPTLALVPGGAAARPRPQQRYSFDGDYGALFQSHSYPRRARRTKRHRSTLHSSLGNRARLCLRKKKRNI

SEQ ID NO: 771266 - protein, 157 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPFTPG

SEQ ID NO: 771267 - protein, 139 aa, Homo sapiens
MESGFTSKDTYLSHFNPRDYLEKYYKFGSRHSAESQILKHLLKIGSGPTIYQLLSACESFKEIVVTDYSDQNLQELEKWLKKEPEAFDWSPVVTYVCDLEGNRVKGPEKEEKLRQAVKQVLKCDVTQSQPLGAVPFTPG

SEQ ID NO: 771268 - protein, 157 aa, Homo sapiens; identical to SEQ ID NO: 771266

SEQ ID NO: 771269 - protein, 157 aa, Homo sapiens; identical to SEQ ID NO: 771266

SEQ ID NO: 771270 - protein, 157 aa, Homo sapiens; identical to SEQ ID NO: 771266

SEQ ID NO: 771271 - protein, 103 aa, Homo sapiens
MESGFTSKDTYLSHFNPRDYLEKYYKFGSRHSAESQILKHLLKIGSGPTIYQLLSACESFKEIVVTDYSDQNLQELEKWLKKEPEAFDWSPVVTYVCDLEGNR

SEQ ID NO: 771272 - protein, 110 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAVPFTPG

SEQ ID NO: 771273 - protein, 126 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYDHGCAQEQLLHDW

SEQ ID NO: 771274 - protein, 157 aa, Homo sapiens; identical to SEQ ID NO: 771266

SEQ ID NO: 771275 - protein, 157 aa, Homo sapiens; identical to SEQ ID NO: 771266

SEQ ID NO: 771276 - protein, 157 aa, Homo sapiens; identical to SEQ ID NO: 771266

SEQ ID NO: 771277 - protein, 97 aa, Homo sapiens
HSRGSAITSALLSACESFKEIVVTDYSDQNLQELEKWLKKEPEAFDWSPVVTYVCDLEGNRVKGPEKEEKLRQAVKQVLKCDVTQSQPLGAVPLTPG

SEQ ID NO: 771278 - protein, 121 aa, Homo sapiens [sequence omitted]

SEQ ID NO: 771279 - protein, 172 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVMRAQHTVSGCRLPRPPPPTAGRSGTSAAY

SEQ ID NO: 771280 - protein, 121 aa, Homo sapiens [sequence omitted]

SEQ ID NO: 771281 - protein, 782 aa, Homo sapiens
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 771282 - protein, 114 aa, Homo sapiens
ARWEALSLPSHLSPGAMVRKPSSTMWMETFSRYLLSANRSAIFLGPQGSLNLQAMYLDEYRDRLFLGGLDALYSLRLDQAWPDPREVLWPPQPGQREECVRKGRDPLVSAVGRD

SEQ ID NO: 771283 - protein, 76 aa, Homo sapiens
FIVSPPRDMSNHAVAQTALRAFTLDSGLAGSRQGPLGSYSRKRREEEHKILSNEHLHLEKVDSFCQPHPTHGTVCY

SEQ ID NO: 771284 - protein, 36 aa, Homo sapiens
MKERDYGPEAQLHLEALGVPKPWATSPSALPGEDSY

SEQ ID NO: 771285 - protein, 138 aa, Homo sapiens
TAQQDQEFPKPQPPEAQAQGLQVLDTTQGPWGCHPAPLSWDACGSRNSRWPYFIFPLKNICLDHKFPIPGGLRHGINANWSQVFWELCHLLASEGIQVCCFQLWLIYQGPRPVFTNAAHPMHSGRDSDAFGAEGHPRL

SEQ ID NO: 771286 - protein, 178 aa, Homo sapiens
SLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMCYSFAAVGGMEGLKEKYFLALASNRSENSSC

SEQ ID NO: 771287 - protein, 140 aa, Homo sapiens
MLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMCYSFAAVGGMEGLKEKYFLALASNRSENSSC

SEQ ID NO: 771288 - protein, 113 aa, Homo sapiens [sequence omitted]

SEQ ID NO: 771289 - protein, 72 aa, Homo sapiens
NYLGDHGMWFWSSEEVPGWSRFSIDEPIEAMGVDEVAQEEGQVRDLGNLTTEGLEKEEEQRSRRKTRISGNL

SEQ ID NO: 771290 - protein, 321 aa, Homo sapiens
GVVTVGRRRRAAESERLNRPFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSEWPNAPLFSNLEDSWVAPWLSKESLTLGYQFRQRGHRKIRKLALVSRKKYT

SEQ ID NO: 771291 - protein, 175 aa, Homo sapiens
RLTRSARGWRPGAERPRAPALAAALETGNGSGHASADCGNARDSWSPGLQRNALLPGLSFPDCITGIQWVPWRKGAEEAARPQLARDPHAPITPRGATMLPTAQIASADPAGGSGLDASFPPQTRRGHATYPLPAYCRPQTETVQPCALLRLPEVSASAGREHAARARAPTGSPP

SEQ ID NO: 771292 - protein, 291 aa, Homo sapiens
MVREQYTTATEGICIERPENQYVYKIGIYGWRKRCLYLFVLLLLIILVVNLALTIWILKVMWFSPAGMGHLCVTKDGLRLEGESEFLFPLYAKEIHSRVDSSLLLQSTQNVTVNARNSEGEVTGRLKVGPKMVEVQNQQFQINSNDGKPLFTVDEKEVVVGTDKLRVTGPEGALFEHSVETPLVRADPFQDLRLESPTRSLSMDAPRGVHIQAHAGKIEALSQMDILFHSSDGMLVLDAETVCLPKLVQGTWGPSGSSQSLYEICVCPDGKLYLSVAGVSTTCQEHSHICL

SEQ ID NO: 771293 - protein, 121 aa, Homo sapiens
RKMATSGGEEAAAAAPAPGTPATGADTTPGWEVAVRPLLSASYSAFEMKELPQLVASVIERYRAAALAGDAVVGGGDFEPDRLDPLSGPPPAPLRIPATATASGSRARGDWLAWVSLRQRM

SEQ ID NO: 771294 - protein, 337 aa, Homo sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 771295 - protein, 337 aa, Homo sapiens; identical to SEQ ID NO: 771294

SEQ ID NO: 771296 - protein, 337 aa, Homo sapiens; identical to SEQ ID NO: 771294

SEQ ID NO: 771297 - protein, 715 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSEYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 771298 - protein, 735 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 771299 - protein, 628 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 771300 - protein, 584 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 771301 - protein, 528 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 771302 - protein, 556 aa, Homo sapiens
MAETVSGTRGSSTGAHISPQFPASVPQVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 771303 - protein, 584 aa, Homo sapiens; identical to SEQ ID NO: 771300

SEQ ID NO: 771304 - protein, 264 aa, Homo sapiens
GVGDIGRGGVKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 771305 - protein, 584 aa, Homo sapiens; identical to SEQ ID NO: 771300

SEQ ID NO: 771306 - protein, 584 aa, Homo sapiens; identical to SEQ ID NO: 771300

SEQ ID NO: 771307 - protein, 540 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQIPIAVLPAQQSLWLLPAPLLPELPCRGPPH

SEQ ID NO: 771308 - protein, 481 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGGDSGLGGVEWG

SEQ ID NO: 771309 - protein, 135 aa, Homo sapiens
VDDQGGWGKRLTTAGPSCSCADAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 771310 - protein, 133 aa, Homo sapiens
RLPSALILGPLGLLALVLSPLSLFALILGPLCLFALVLGPFYLFGLVLSPLGLSALVLGPPPPFSPGFGVVSTFLPWEQGERGRKEGGRRGKRPGQAGGQECKTLSAMRCLQLTVSNAANLHDCLGQWMGLFQ

SEQ ID NO: 771311 - protein, 847 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771312 - protein, 847 aa, Homo sapiens; identical to SEQ ID NO: 771311

SEQ ID NO: 771313 - protein, 847 aa, Homo sapiens; identical to SEQ ID NO: 771311

SEQ ID NO: 771314 - protein, 847 aa, Homo sapiens; identical to SEQ ID NO: 771311

SEQ ID NO: 771315 - protein, 847 aa, Homo sapiens; identical to SEQ ID NO: 771311

SEQ ID NO: 771316 - protein, 847 aa, Homo sapiens; identical to SEQ ID NO: 771311

SEQ ID NO: 771317 - protein, 847 aa, Homo sapiens; identical to SEQ ID NO: 771311

SEQ ID NO: 771318 - protein, 895 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771319 - protein, 866 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRQKIFTLPGLGTRISNVHSTQHTSPKNHPLGNLAISPDTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771320 - protein, 793 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGEI

SEQ ID NO: 771321 - protein, 300 aa, Homo sapiens
MSKSFQQSSLSRDSQGHGRDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771322 - protein, 847 aa, Homo sapiens; identical to SEQ ID NO: 771311

SEQ ID NO: 771323 - protein, 847 aa, Homo sapiens; identical to SEQ ID NO: 771311

SEQ ID NO: 771324 - protein, 847 aa, Homo sapiens; identical to SEQ ID NO: 771311

SEQ ID NO: 771325 - protein, 835 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKTISE

SEQ ID NO: 771326 - protein, 640 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKSSSSDSRSILGSCSVWSSFVSFSPSSPDF

SEQ ID NO: 771327 - protein, 575 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQLLLKWSPIRGLATISRGFLEIYKNPKYKKLIDAIDRKDHHC

SEQ ID NO: 771328 - protein, 421 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDVSNGGYNREGILAESDW

SEQ ID NO: 771329 - protein, 106 aa, Homo sapiens
MEKGVGMILFLVRPRITIINLTVSMREWDVVLAPYKRDLSLRKREALLQVAILKTSMDSYRRVIPICALYVICQFILIRSGVNISMEQVTVVDASFFLKCRSLKYL

SEQ ID NO: 771330 - protein, 847 aa, Homo sapiens; identical to SEQ ID NO: 771311

SEQ ID NO: 771331 - protein, 847 aa, Homo sapiens; identical to SEQ ID NO: 771311

SEQ ID NO: 771332 - protein, 559 aa, Homo sapiens
MLGAQWRRNQPSRAAEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771333 - protein, 791 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771334 - protein, 826 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771335 - protein, 847 aa, Homo sapiens; identical to SEQ ID NO: 771311

SEQ ID NO: 771336 - protein, 819 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTFFKYNTDS

SEQ ID NO: 771337 - protein, 198 aa, Homo sapiens
MVEMADLLHGSHHTEYLGMIGKKKGTLEETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 771338 - protein, 718 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKAVPADRSLMKECGPCMSMTLDKALR

SEQ ID NO: 771339 - protein, 585 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRDPNRHDY

SEQ ID NO: 771340 - protein, 325 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEM

SEQ ID NO: 771341 - protein, 146 aa, Homo sapiens
SAGVIIFSGVCNSVLTINATMPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 771342 - protein, 146 aa, Homo sapiens; identical to SEQ ID NO: 771341

SEQ ID NO: 771343 - protein, 146 aa, Homo sapiens; identical to SEQ ID NO: 771341

SEQ ID NO: 771344 - protein, 146 aa, Homo sapiens; identical to SEQ ID NO: 771341

SEQ ID NO: 771345 - protein, 97 aa, Homo sapiens
WTPLKDGLRLSAEPWLTFSKSELLLFIFRRCRDFGGGGGGENVSIPLLSLGNSKAKEADLLIPVPTLLFCPEEPSVGWRRCQVVEFEWSVGPFLVSL

SEQ ID NO: 771346 - protein, 106 aa, Homo sapiens
ARQPAKPPSSYIALITMAILQSPHKRLTLSGICAFISDRFPYYRRKFPAWQNSIRHNLSLNDCFVKIPREPGRPGKGNYWSLDPASQDMFDNGSFLRRRKRFQRHQ

SEQ ID NO: 771347 - protein, 107 aa, Homo sapiens [sequence omitted]

SEQ ID NO: 771348 - protein, 167 aa, Homo sapiens
LRTAHLPCSALNHQGSQNGDQRWEEHRRRCTQDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 771349 - protein, 189 aa, Homo sapiens
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 771350 - protein, 149 aa, Homo sapiens
LNNKKAWGSKGPLMRWKDQSLLGTCKNKNMQLSQEGNPRVQEIELFFFFSFFLRQGLALSPRLECSSMISAHCNLHLLGSSESPASAPQVAGTKGMCQHARLVFVFLVETGFRHVGQADLELLTSDELPASAAQSVGVTTVSYQARPKR

SEQ ID NO: 771351 - protein, 93 aa, Homo sapiens
VLYQMFVSNCLQLFAPKGFRLARLSSWRVHAGLVSHSAVRPHQGALVERIIPHPLYSAQNHDYDVALLRLQTALNFSGSAVGEAKPDWGPGPC

SEQ ID NO: 771352 - protein, 457 aa, Homo sapiens
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 771353 - protein, 198 aa, Homo sapiens
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 771354 - protein, 70 aa, Homo sapiens
PQPVGIQPASITAVTGSTFGEHLKEARGGGGFPRAHECGWTCRHAVMYPCSVCLCLHVHTSDAPVYVCQA

SEQ ID NO: 771355 - protein, 674 aa, Homo sapiens
MAFLSRTSPVAAASFQSRQAGGQRLHPASELPAAPAMAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 771356 - protein, 699 aa, Homo sapiens
MAFLSRTSPVAAASFQSRQAGGQRLHPASELPAAPAMAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGGCQPLAGAGAGVQAGGLTPALGLPGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 771357 - protein, 567 aa, Homo sapiens
MAFLSRTSPVAAASFQSRQAGGQRLHPASELPAAPAMAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGGCQPLAGAGAGVQAGGLTPALGLPGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHWFYSSTGLETHASLLPPLPKGLQGRRIQALNGDLQVGFRKSAEMDSGQLVTRGADQSPTKTAGQSIRYGAQYVMR

SEQ ID NO: 771358 - protein, 674 aa, Homo sapiens; identical to SEQ ID NO: 771355

SEQ ID NO: 771359 - protein, 654 aa, Homo sapiens
LLASTLCSDGCAELGAPSPSQVHYGSDSSMSPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGGCQPLAGAGAGVQVRWPHTSPWPPRSRPGPQGWQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 771360 - protein, 98 aa, Homo sapiens
EGHQEGLVELPASFRELLTFFCTNATIHGAIRLVCSRGNRLKTTSWGLLSLGALVALCWQLGLLFERHWHRPVLMAVSVHSERKLLPLVTLCDGNPRR

SEQ ID NO: 771361 - protein, 98 aa, Homo sapiens
MAPVGHRFHLAFSCPNTCTFAKSFPPVAQMLFLCANCLRQSSPLANVGSFKEQMRLATHLGAHHSQCSVGRPCTPDVARAFSPSLKSWRAQHTLTHPG

SEQ ID NO: 771362 - protein, 105 aa, Homo sapiens
QEWWLTPVIPALEAEVEGSLEAQEFKTSLGNMAVSTSSKTLVGHGGACRQSQLLRKLWWEDHLSGGEEGVKAAVSHDHTTTLQPGQQRKTLSQKRKKEIKYVSVI

SEQ ID NO: 771363 - protein, 110 aa, Homo sapiens
MPPDLSIGLEDQHWDDDEQNGHEDAQNQGPDVQALGGGGIGLGPGHVANHLPVPRLHGVGECYEAQAAGVHEEGVEQGPDEHGRARRSRCGCGSRWTSGNRVLGRPHKAT

SEQ ID NO: 771364 - protein, 744 aa, Homo sapiens
PSVSYQQPHRSEAVEAGRSGVKMAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLAPSGGGPPRGFFSPEVFPPPGPLFGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 771365 - protein, 730 aa, Homo sapiens
PSVSYQQPHRSEAVEAGRSGVKMAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 771366 - protein, 550 aa, Homo sapiens
KLPESHGWSRQAVGAPRGAAANPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSDYMRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTGGKKGAMKPCGLFLPFCTRDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 771367 - protein, 397 aa, Homo sapiens
KLPESHGWSRQAVGAPRGAAANPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSDYMRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTGGKKGAMKPCGLFLPFCTRDGTAGTPAISTTTTVEIRKSSVMTTEITSKVEKSPTTATGNSSCPSTETEEEKAKRLLYCSLCKVAVNSASQLEAHNSGEMQRFLFCFNSSAIIFL

SEQ ID NO: 771368 - protein, 135 aa, Homo sapiens
KLPESHGWSRQAVGAPRGAAANPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSD

SEQ ID NO: 771369 - protein, 531 aa, Homo sapiens
KLPESHGWSRQAVGAPRGAAANPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSDYMRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 771370 - protein, 378 aa, Homo sapiens
KLPESHGWSRQAVGAPRGAAANPGWGGVGWRGLLVVLSVLMSQARQGHRKEESDYSKDGQCSRQPERTLQPPGILALERQPARRSSRGGGTLSALTALHAGDISTECSMKGLCSTCQPWVRADAEDTAVGFQLSDYMRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGEMQRFLFCFNSSAIIFL

SEQ ID NO: 771371 - protein, 522 aa, Homo sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 771372 - protein, 433 aa, Homo sapiens
MFFFSVSSLLRFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 771373 - protein, 293 aa, Homo sapiens
FIFFLLGRGLKNKKLRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 771374 - protein, 304 aa, Homo sapiens
MCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 771375 - protein, 423 aa, Homo sapiens
MFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 771376 - protein, 423 aa, Homo sapiens; identical to SEQ ID NO: 771375

SEQ ID NO: 771377 - protein, 260 aa, Homo sapiens
MDVGAFTSGQIRAQRELTSSHHLELSPCLASGLTFQYVPSDETISSAESFSTMWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 771378 - protein, 209 aa, Homo sapiens
IPAHGGTRPAPMAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETLRLASSYIAHLANVLLLGDSADDGQPCFRAAGSAKGAVPAAPTRRQPRSICTFCLSNQRKGGGRRDLGGSCLKVRGVAPLRGPRR

SEQ ID NO: 771379 - protein, 401 aa, Homo sapiens
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 771380 - protein, 408 aa, Homo sapiens
MHLYKPACADIPSPKLGLPKSSESALKCRWHLAVTKTQPQAACKPVRPSGAAEQKYVEKFLRVHGISLQETTRAETGMAYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 771381 - protein, 408 aa, Homo sapiens; identical to SEQ ID NO: 771380

SEQ ID NO: 771382 - protein, 408 aa, Homo sapiens; identical to SEQ ID NO: 771380

SEQ ID NO: 771383 - protein, 419 aa, Homo sapiens
MLAARTGAAGSQISEENTKLRRQSGFSVAGKDKSPKKASENAKDSSLSPSGESQLRARQMALLREVCMNWYLKLCDLVREHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 771384 - protein, 401 aa, Homo sapiens; identical to SEQ ID NO: 771379

SEQ ID NO: 771385 - protein, 295 aa, Homo sapiens
MTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 771386 - protein, 151 aa, Homo sapiens
MHLYKPACADIPSPKLGLPKSSESALKCRWHLAVTKTQPQAACKPVRPSGAAEQKYVEKFLRVHGISLQETTRAETGMAYRNLGKSGLRVSCLGLGTWVTFGGQISDEVAERLMTIAYESGVNLFDTAEVYAAGKAEVILGSIIKKKGWRK

SEQ ID NO: 771387 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 771388 - protein, 198 aa, Homo sapiens
MKQELIILSCPFVSLTYRERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 771389 - protein, 224 aa, Homo sapiens; identical to SEQ ID NO: 771387

SEQ ID NO: 771390 - protein, 224 aa, Homo sapiens; identical to SEQ ID NO: 771387

SEQ ID NO: 771391 - protein, 151 aa, Homo sapiens
MWSTVPGGTRPSSAMWLKHRHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 771392 - protein, 254 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771393 - protein, 341 aa, Homo sapiens
HYRRSIPTGRGKHCAWEVVVLSERASRQQAAGGRADGTEGGSERAVSKPARAVGSRGQPRFLRSLRPPPWSPQRLRCPEDRTRPGPAMASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771394 - protein, 330 aa, Homo sapiens
IQLGTRPGGESERASRQQAAGGRADGTEGGSERAVSKPARAVGSRGQPRFLRSLRPPPWSPQRLRCPEDRTRPGPAMASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771395 - protein, 323 aa, Homo sapiens
RPFSVYMHVCLGCVRDWTGTEGGSERAVSKPARAVGSRGQPRFLRSLRPPPWSPQRLRCPEDRTRPGPAMASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771396 - protein, 254 aa, Homo sapiens; identical to SEQ ID NO: 771392

SEQ ID NO: 771397 - protein, 193 aa, Homo sapiens
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771398 - protein, 227 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAEDYRRTVTEIDEKEYISLRLIISELRNQYVTLHDMILKNIEKIKRPRSSNAETLY

SEQ ID NO: 771399 - protein, 97 aa, Homo sapiens
AWISRGYSAEGDSEAASYLDQISRYYITRAKLVSKIAKYPHVEDYRRTVTEIDEKEYISLRLIISELRNQYVTLHDMILKNIEKIKRPRSSNAETLY

SEQ ID NO: 771400 - protein, 254 aa, Homo sapiens; identical to SEQ ID NO: 771392

SEQ ID NO: 771401 - protein, 103 aa, Homo sapiens [sequence omitted]

SEQ ID NO: 771402 - protein, 103 aa, Homo sapiens [sequence omitted]

SEQ ID NO: 771403 - protein, 103 aa, Homo sapiens [sequence omitted]

SEQ ID NO: 771404 - protein, 171 aa, Homo sapiens
MEKWILKKIKYLQSGGLSASYYSYKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTQMWGTVLIPRLSGTLGGPRRTCSRR

SEQ ID NO: 771405 - protein, 210 aa, Homo sapiens
IQLGTRPGGESERASRQQAAGGRADGTEGGSERAVSKPARAVGSRGQPRFLRSLRPPPWSPQRLRCPEDRTRPGPAMASLLKVDQEVKLKVDSFRERITSEAEDLVANFFPKKLLELDSFLKEPILNIHDLTQIHSDMNLPVPDPILLTKLAIDWTLGLGLPQTLLNATADNGFGDLNGWVEGKRARFRKRGKPESGWLMAGLGREIGGV

SEQ ID NO: 771406 - protein, 254 aa, Homo sapiens; identical to SEQ ID NO: 771392

SEQ ID NO: 771407 - protein, 254 aa, Homo sapiens; identical to SEQ ID NO: 771392

SEQ ID NO: 771408 - protein, 267 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTPSGKGPHICFDLQVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771409 - protein, 132 aa, Homo sapiens
SDTESAVIEKVNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 771410 - protein, 254 aa, Homo sapiens; identical to SEQ ID NO: 771392

SEQ ID NO: 771411 - protein, 254 aa, Homo sapiens; identical to SEQ ID NO: 771392

SEQ ID NO: 771412 - protein, 254 aa, Homo sapiens; identical to SEQ ID NO: 771392

SEQ ID NO: 771413 - protein, 505 aa, Homo sapiens
ELRAGRWEGGLTLGTQAVWGQFHQGPVPRIGEGGTSGAGGEGASALRPSLAPSGAPAGRKGSEKSVLPVLPPATCGPGGSPQAPGPQRRWPGRGQSLPLRVQPVLSLPQRRRCRLSSPSCCNRPTMDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 771414 - protein, 137 aa, Homo sapiens
MVTLHVRGRLTPDISNPKRLGAGRDPRQPGPHAAPGSASVHQGAGAAEPFSPDTLVSSENARSPPSCCSRLWRTRLYWCHMPAAGCAMEGGTCLFSRGSSGTGNFRDPSWAEPPRAEALWVASNSSLMGPASRPNGR

SEQ ID NO: 771415 - protein, 37 aa, Homo sapiens
MEWPPLNIPPCCTSDSFQQSQAQEAVVGTQAWHLLAA

SEQ ID NO: 771416 - protein, 82 aa, Homo sapiens
FMTKNPKANAIKTKINSWDLIKLKSFCMAKGTVSRVNRQPTEWVKIFTVYTSDKGLISRIYNKIKQISKKITNNPIKNRPRT

SEQ ID NO: 771417 - protein, 152 aa, Homo sapiens
RSAADGAFVSGEFCGGKLLRWCLVTDFPPDSCTTCSYSRRSTPGCSPGGERPCGLPRLPTPIARVLAALAASRSRAGGAPPGSSLIAHAPSGVPIQPSALFCPKVVLTRIHVAHPTPTGAELGIPAMPSQSTFTISLLSQHLACCVLTTLCL

SEQ ID NO: 771418 - protein, 96 aa, Homo sapiens
RSAADGAFVSGSRGLSEGEGSSVSLQRSRVLSAMKHVLNLYLLGVVLTLLSIFVRVMESLEGLLESPSPGTSWTTRSQLANTEPTKGLPDHPSRSM

SEQ ID NO: 771419 - protein, 134 aa, Homo sapiens
RSAADGAFVSGEFCGGKLLRWCLVTDFPPDSCTTCSYSRRSTPGCSPGGSRGLSEGEGSSVSLQRSRVLSAMKHVLNLYLLGVVLTLLSIFVRVMESLEGLLESPSPGTSWTTRSQLANTEPTKGLPDHPSRSM

SEQ ID NO: 771420 - protein, 96 aa, Homo sapiens; identical to SEQ ID NO: 771418

SEQ ID NO: 771421 - protein, 96 aa, Homo sapiens; identical to SEQ ID NO: 771418

SEQ ID NO: 771422 - protein, 96 aa, Homo sapiens; identical to SEQ ID NO: 771418

SEQ ID NO: 771423 - protein, 96 aa, Homo sapiens; identical to SEQ ID NO: 771418

SEQ ID NO: 771424 - protein, 613 aa, Homo sapiens
PASAERPYKCAECGKSFKGSSGLRYHLRDHTGERPYQCGECGKAFKRSSLLAIHQRVHTGLRAFTCGQCGLTFKWSSHYQYHLRLHSGERPYACGECGKAFRNTSCLRRHRHVHTGERPHACGVCGKSFAQTSNLRQHQRVHTGERPFRCPLCPKTFTHSSNLLLHQRTHSAERPFTCPICGRGFVMAAYLQRHLRTHAPANTPPSTTAPAAGPQPPAPLAAARAPPATQDVHVLPHLQATLSLEVAGGTAQAPSLGPAAPNSQTFLLVQTAQGLQLIPSSVQPPTPPPPPAPPKLILLPSSSAGAGGGRARQGPRAVGKAGQGAGVVWLPGPGGLGVQGAASAGASGTGQSLIVLQNVGGGEAGPQEMSGVQLQPLRPAPEVTTVQLQPAQEVTTVQLQPAQEVTTVQLQPAQEVTTVQLQPVAGQLSNSSGGAVATEAPNLLVVQSGAAEELLTGPGPGEAGDGEASTGVVQDVLFETLQTDEGLQSVLVLSGADGEQTRLCVQEVETLPPGLTEPPATGPPGQKLLIIRSAPATELLDSSNTGGGTATLQLLAPPPSGPASGPAGLPGAPASQMVQVVPAGAGPGVMTPQGLPSIQIVQTLPAVQLVHTF

SEQ ID NO: 771425 - protein, 556 aa, Homo sapiens
PASAERPYKCAECGKSFKGSSGLRYHLRDHTGERPYQCGECGKAFKRSSLLAIHQRVHTGLRAFTCGQCGLTFKWSSHYQYHLRLHSGERPYACGECGKAFRNTSCLRRHRHVHTGERPHACGVCGKSFAQTSNLRQHQRVHTGERPFRCPLCPKTFTHSSNLLLHGPRQPPKMSTSCPTIQATLSLEVAGGTAQAPSLGPAAPNSQTFLLVQTAQGLQLIPSSVQPPTPPPPPAPPKLILLPSSSAGAGGGRARQGPRAVGKAGQGAGVVWLPGPGGLGVQGAASAGASGTGQSLIVLQNVGGGEAGPQEMSGVQLQPLRPAPEVTTVQLQPAQEVTTVQLQPAQEVTTVQLQPAQEVTTVQLQPVAGQLSNSSGGAVATEAPNLLVVQSGAAEELLTGPGPGEAGDGEASTGVVQDVLFETLQTDEGLQSVLVLSGADGEQTRLCVQEVETLPPGLTEPPATGPPGQKLLIIRSAPATELLDSSNTGGGTATLQLLAPPPSGPASGPAGLPGAPASQMVQVVPAGAGPGVMTPQGLPSIQIVQTLPAVQLVHTF

SEQ ID NO: 771426 - protein, 34 aa, Homo sapiens
FAHPSFAASLKMGPPKSKAEKIKRSPMDKVLRFA

SEQ ID NO: 771427 - protein, 256 aa, Homo sapiens
SCPTPRVTRAGSLWTGGSARPRTAARPARGKEPVGVGGAVGGGDPPALGGPSPRRLLSGWGGGGAAEMSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVSYAFVI

SEQ ID NO: 771428 - protein, 612 aa, Homo sapiens
ILSDSAGDTSRFSLDWWQRAAPNRRQAGTGEGAGGGRGCGGGWGPSGSWGSQSPPAAERVGWWRSCRDVRPEPDGPNHCRPAQCHRLCRIQDSMQGHDPRDHGAQEKAPGLADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNCEPKVAPTTAWNAATMAPPVMAYPATTPTGMIGYGIPPQMGSVPVMTQPTLIYSQPVMRPPNPFGPVSGAQIQFM

SEQ ID NO: 771429 - protein, 719 aa, Homo sapiens
SCPTPRVTRAGSLWTGGSARPRTAARPARGKEPVGVGGAVGGGDPPALGGPSPRRLLSGWGGGGAAEMSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNCEPKVAPTTAWNAATMAPPVMAYPATTPTGMIGYGIPPQMGSVPVMTQPTLIYSQPVMRPPNPFGPVSGAQIQFM

SEQ ID NO: 771430 - protein, 361 aa, Homo sapiens
SCPTPRVTRAGSLWTGGSARPRTAARPARGKEPVGVGGAVGGGDPPALGGPSPRRLLSGWGGGGAAEMSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQVSLSLKYQSTICCVQVVKSIKISNI

SEQ ID NO: 771431 - protein, 131 aa, Homo sapiens
MTLSPLFYILMGHNYWRVYPFCRKCKNGLAEEIKFMFKYYFFTAPGNKHFKHVLAADSALWNGCDPVSNGFEQKRGSDWQKSPEIDLCLGKVVCPEIELCLDRVACRARDDSVKPCLFLLLALCFLLCWLP

SEQ ID NO: 771432 - protein, 115 aa, Homo sapiens
LTFTTNFHSIALPVFGAKCLKIIAYLLLSTIYLFPLSPNPIPGRPLALHLHPSCLSCPRQGHLTSQLLYLLVMSVSCDSVLMLLATLSVLGMASSTALSSGAPPAGPVPLLSVLC

SEQ ID NO: 771433 - protein, 525 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 771434 - protein, 493 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 771435 - protein, 559 aa, Homo sapiens
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCATKLEVYMKPFSDVHNGKQRQLYSMKNETRSVCLVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 771436 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 771437 - protein, 424 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAV

SEQ ID NO: 771438 - protein, 188 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVLKPSQTGHWEQDQKKQAWGCHAQ

SEQ ID NO: 771439 - protein, 1078 aa, Homo sapiens; identical to SEQ ID NO: 771436

SEQ ID NO: 771440 - protein, 1088 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREPLTFVLSVLQVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 771441 - protein, 133 aa, Homo sapiens
KHGVHAVWPAGCRYEHTWWHAQSHTVSGIDVKLTSSEVNPLSVASTICHWLYNIVLSLIRDSSTYAMIHRCVYHHGASILILELVGHSFLLISVFFVVTCWNHRSETSFQQLTLASPRFSIINIVGSILEGKM

SEQ ID NO: 771442 - protein, 127 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKHEQGTTTGIWQNLPQETTGRRLRRTA

SEQ ID NO: 771443 - protein, 127 aa, Homo sapiens; identical to SEQ ID NO: 771442

SEQ ID NO: 771444 - protein, 127 aa, Homo sapiens; identical to SEQ ID NO: 771442

SEQ ID NO: 771445 - protein, 127 aa, Homo sapiens; identical to SEQ ID NO: 771442

SEQ ID NO: 771446 - protein, 127 aa, Homo sapiens; identical to SEQ ID NO: 771442

SEQ ID NO: 771447 - protein, 127 aa, Homo sapiens; identical to SEQ ID NO: 771442

SEQ ID NO: 771448 - protein, 127 aa, Homo sapiens; identical to SEQ ID NO: 771442

SEQ ID NO: 771449 - protein, 127 aa, Homo sapiens; identical to SEQ ID NO: 771442

SEQ ID NO: 771450 - protein, 127 aa, Homo sapiens; identical to SEQ ID NO: 771442

SEQ ID NO: 771451 - protein, 127 aa, Homo sapiens; identical to SEQ ID NO: 771442

SEQ ID NO: 771452 - protein, 127 aa, Homo sapiens; identical to SEQ ID NO: 771442

SEQ ID NO: 771453 - protein, 127 aa, Homo sapiens; identical to SEQ ID NO: 771442

SEQ ID NO: 771454 - protein, 127 aa, Homo sapiens; identical to SEQ ID NO: 771442

SEQ ID NO: 771455 - protein, 127 aa, Homo sapiens; identical to SEQ ID NO: 771442

SEQ ID NO: 771456 - protein, 127 aa, Homo sapiens; identical to SEQ ID NO: 771442

SEQ ID NO: 771457 - protein, 127 aa, Homo sapiens
GRPWQVSSTGMDVELTVEERNLLSVAYKNVIGARRASWRIISSIEQKEENKGGEDKLKMIREYRQMVETELKLICCDILDVLDKHLIPAANTGESKVFYYKHEQGTTTGIWQNLPQETTGRRLRRTA

SEQ ID NO: 771458 - protein, 154 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGTGDYHRYLAEFATGNDRKEAAENSLVAYKAASDIAMTELPPSASYSLRSCSQFFRILLRNS

SEQ ID NO: 771459 - protein, 147 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKHRKEAAENSLVAYKAASDIAMTELPPSASYSLRSCSQFFRILLRNS

SEQ ID NO: 771460 - protein, 69 aa, Homo sapiens
DELGYDERTGDYHRYLAEFATGNDRKEAAENSLVAYKAASDIAMTELPPSASYSLRSCSQFFRILLRNS

SEQ ID NO: 771461 - protein, 127 aa, Homo sapiens; identical to SEQ ID NO: 771442

SEQ ID NO: 771462 - protein, 127 aa, Homo sapiens; identical to SEQ ID NO: 771442

SEQ ID NO: 771463 - protein, 79 aa, Homo sapiens
SGGGGVGWRDVLSSAGSERLRESETLSASIRRADPAGAAAAMDDREDLVYQAKLAEQAERYDGEEQNKEALQDVEDENQ

SEQ ID NO: 771464 - protein, 127 aa, Homo sapiens; identical to SEQ ID NO: 771442

SEQ ID NO: 771465 - protein, 127 aa, Homo sapiens; identical to SEQ ID NO: 771442

SEQ ID NO: 771466 - protein, 127 aa, Homo sapiens; identical to SEQ ID NO: 771442

SEQ ID NO: 771467 - protein, 142 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKHCRFYTRRENVRLKVGPFRTITLFYVGFQLLFKNNCSMLEG

SEQ ID NO: 771468 - protein, 122 aa, Homo sapiens
MVESMKKVAGMDVELTVEERNLLSVAYKNVIGARRASWRIISSIEQKEENKGGEDKLKMIREYRQMHSSPPSLAQPLLFSMCNLKLICTTGYLTGATDTESVLFLLKHSMELTLNLNKTNLN

SEQ ID NO: 771469 - protein, 82 aa, Homo sapiens
MVESMKKVAGMDVELTVEERNLLSVAYKNVIGARRASWRIISSIEQKEENKGGEDKLKMIREYRQMLSQRWDSDRGENSVRG

SEQ ID NO: 771470 - protein, 142 aa, Homo sapiens; identical to SEQ ID NO: 771467

SEQ ID NO: 771471 - protein, 127 aa, Homo sapiens
MDDREDLVYQAKLAEQAERYDEMSEPMKAAGMHAQPADPDSNLLSAAYTTAPAARLRLSRPLTSLLPQAAHQVAPAPLLHDRPLSTSALSLNLLVQPALTSPPPSSHPTPSSTFPIPIPTACSFSPP

SEQ ID NO: 771472 - protein, 127 aa, Homo sapiens; identical to SEQ ID NO: 771442

SEQ ID NO: 771473 - protein, 127 aa, Homo sapiens; identical to SEQ ID NO: 771442

SEQ ID NO: 771474 - protein, 127 aa, Homo sapiens; identical to SEQ ID NO: 771442

SEQ ID NO: 771475 - protein, 127 aa, Homo sapiens; identical to SEQ ID NO: 771442

SEQ ID NO: 771476 - protein, 118 aa, Homo sapiens
MVESMKKVAGMDVELTVEERNLLSVAYKNVIGARRASWRIISSIEQKEENKGGEDKLKMIREYRQMCDILDVLDKHLIPAANTGESKVFYYKHEQGTTTGIWQNLPQETTGRRLRRTA

SEQ ID NO: 771477 - protein, 127 aa, Homo sapiens; identical to SEQ ID NO: 771442

SEQ ID NO: 771478 - protein, 83 aa, Homo sapiens
TNDTGISAQSAWKLSLKESFTSVTFWMFVYKQLSSSSHLAARRKFQYVFLIAIDLNRGLPQVSGRICHRKRQEGGCGEQPSGL

SEQ ID NO: 771479 - protein, 127 aa, Homo sapiens; identical to SEQ ID NO: 771442

SEQ ID NO: 771480 - protein, 77 aa, Homo sapiens
SPLIPYDRITGHYTVEVFCDNRSKRKECAGNELAEMTSGLLRALIKDMAYGRDKPDELKISNYTMSYLDVFSHRLSI

SEQ ID NO: 771481 - protein, 107 aa, Homo sapiens
RTLTVEVSVETIRNPQQQESLKHATRIIDEVVNKFLDDLGNAKSHLMSLYSACSSEDPRVLGRKAIRDSTLIMQLLRDNLTLWTSDMQGDGEEQNKEALQDVEDENQ

SEQ ID NO: 771482 - protein, 127 aa, Homo sapiens; identical to SEQ ID NO: 771442

SEQ ID NO: 771483 - protein, 127 aa, Homo sapiens; identical to SEQ ID NO: 771442

SEQ ID NO: 771484 - protein, 127 aa, Homo sapiens; identical to SEQ ID NO: 771442

SEQ ID NO: 771485 - protein, 133 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKHIRGLPQDNARGVKSDRKEGAENSIVDDNSAT

SEQ ID NO: 771486 - protein, 78 aa, Homo sapiens
MVESMKKVAGMDVELTVEERNLLSVAYKNVIGARRASWRIISSIEQKEENKGGEDKLKMIREYRQMAMDILDVLDHLF

SEQ ID NO: 771487 - protein, 72 aa, Homo sapiens
SGGGGVGWRDVLSSAGSERLRESETLSASIRRADPAGAAAAMDDREDLVYQAKLAEQAERYDDLKQEISKFL

SEQ ID NO: 771488 - protein, 41 aa, Homo sapiens
MDDREDLVYQAKLAEQAERYDGELGGQRGAGILGPSAAAHR

SEQ ID NO: 771489 - protein, 334 aa, Homo sapiens
LERSHFTTTFLPKCQHGQIRSRSPAHSHPQGESTVGWALIHEGGLPHATAVPPGTRLLITLVLCRYHSILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDGEQ

SEQ ID NO: 771490 - protein, 71 aa, Homo sapiens
SFPRLLAARWWNSVYCLVGPSAGYTLRGAGWNTVLMKSPSGSTGWSPVVTIAFILSNQPPHKPWPGIPWRV

SEQ ID NO: 771491 - protein, 156 aa, Homo sapiens
EPGVGYSLVVRRFLSRSEKRNIRVGVTRFSRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEVLPIFRFFLCEIPSRV

SEQ ID NO: 771492 - protein, 100 aa, Homo sapiens
SRRRLPPQRGELPAQALDRVLPAAGYSRSLPLLLLWLTKAYICSSYLPNDTVESGIHPVYFCSTHYIEMLLKAELPLVFSAFHMSGFAPSQVIHKGVAFL

SEQ ID NO: 771493 - protein, 156 aa, Homo sapiens; identical to SEQ ID NO: 771491

SEQ ID NO: 771494 - protein, 154 aa, Homo sapiens
SRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQVLFSVYCQLECSKLIL

SEQ ID NO: 771495 - protein, 195 aa, Homo sapiens
MWICPGGGGGGGGGGGGGGGGGGGGDREDARPAPLLLWALLALWLCCATPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVAKQFS

SEQ ID NO: 771496 - protein, 228 aa, Homo sapiens
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSGAQRPRWMFSHLD

SEQ ID NO: 771497 - protein, 359 aa, Homo sapiens
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEPAAMAQMQGEESLDLKRRRIHQCDFAGCSKVYTKSSHLKAHRRIHTGEKPYKCTWDGCSWKFARSDELTRHFRKHTGIKPFRCTDCNRSFSRSDHLSLHRRRHDTM

SEQ ID NO: 771498 - protein, 68 aa, Homo sapiens
THTSGYFSCFLLPEGVGVVFQVCSCKPSDEASCIHRGLDGRTSLSPPCLLHSVSFPDGERETQAAVTH

SEQ ID NO: 771499 - protein, 68 aa, Homo sapiens; identical to SEQ ID NO: 771498

SEQ ID NO: 771500 - protein, 918 aa, Homo sapiens
FAEPAAAFPGATAMAASLSERLFSLELLVDWVRLEARLLPSPAAAVEQEEEEEEKEQGEASSPRGLCPAVAFRLLDFPTLLVYPPDGPGAPAAEPWPGVIRFGRGKSCLFRLQPATLHCRLLRTPLATLLLQLPPGRPTPTPQLLGACDISLATAAHRVVGPAASGCSHRHRGRFPLHNRVGERTGDIALAYRLTDLGSRLLSQLERPLTFTRTGGGAEVSPQTQQERQQLQQPASQPSPKEADKPLGELEIPEAQKDLKEMVKSKAECDNVGSVENGKTNSVVTCSGAGNGRNVSSLNEEVTELDMETNIFCPPPLYYTNLTQEKPPPAQAKITIEPQMNAPEEMDDASPEKKRVNPPAHRSCLKHPSSAAHEHPPMLVNPPHIQNIGATNQTCQTEQNRINTIRQLPLLNALLVELSLLYDQPVTSPAHIHPHLAWLYRTEDKKSPESSAKSTCRSEAKKDKRSVGGCEKSVSLQYKKNQIENYKEDKYSEKSSGALHKRVPKGRLLYGLTNTLRLRLKLTNPDMLVVHEKRELYRKRQSQMLGTKFRIPSSKVKLLSSAEQSQKPQLPEDKYLDSDASFTENSDTSRQISGVFDEPSTSKETKLKYATEKKTVDCSKNRINNVSLEEVVSPANSIIPERLTPTNILGGNVEMKIQSPCVFQQDAVVDRIVDKEIDIRQVKTTDNDILMADISDKRTGKNSCYENISELKYSDDLSSPCYSEDFCTSEDTSRSFKAHDSSSRTENPKHSQYTSKSSDTGVSKKKNSSDRSSILSPPFSAGSPVHSYRKFHISKTQDKSLEEASSISASDLSSTHWTEQKENQIDQNSMHNSEITKRAQDISVKTRSSWKSLEKSQSPQTSQVSSYLPSNVSELNVLDSSTSDHFEEGNDDVGSLNISKQCKDICELVINKLPGYTM

SEQ ID NO: 771501 - protein, 918 aa, Homo sapiens; identical to SEQ ID NO: 771500

SEQ ID NO: 771502 - protein, 138 aa, Homo sapiens
VSQDYFLFPQILECVRTLFLMVPTVCFHVCGSTGCSAAKPPWAPLICGRFSCFLVFGDFLRTVGVGYFVGCASVGICLLTRLGSQVLGREDMEVKSFSSHPVQASTVRRTQCLMLMQVTWLRCALQHFPQSSDSFSFH

SEQ ID NO: 771503 - protein, 281 aa, Homo sapiens
HLRQQEGGSFSQAAGRAARIMSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 771504 - protein, 261 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 771505 - protein, 113 aa, Homo sapiens
GDVNCSGRPRPRVAEPPPPLGRSGGYFCIFPPAPRPRCPRMPGGLMKFDLFFPSKYLPHHHGAPRPLPPSFPSLGESFELSPEPRVGHAACRAWEGEWGCSSSCGTVGGVRPR

SEQ ID NO: 771506 - protein, 121 aa, Homo sapiens
GETPRPAERGTPVRLFTEEELARYGGKEGFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 771507 - protein, 121 aa, Homo sapiens; identical to SEQ ID NO: 771506

SEQ ID NO: 771508 - protein, 427 aa, Homo sapiens
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 771509 - protein, 427 aa, Homo sapiens; identical to SEQ ID NO: 771508

SEQ ID NO: 771510 - protein, 100 aa, Homo sapiens
TGALASAQPSRRRRAGSWEFWFALAHSLFTNHWILHASVPPTSTPCPHAPAPATGKGCCVFFLFARCRCVLGNGLWPPSPTLPCPAAPEVPSCHTAVALT

SEQ ID NO: 771511 - protein, 173 aa, Homo sapiens
MLASGLLLVALLASLTVMVLMSVWQQRKSRGKLPLGPTPLLFIGNYLQLNTEHICDSIMKISERYGPVFTIHLGPRRVVVLCGHDAVKEALVDQAEEFSGRGEQATFDWLFKGYGVTCRTWERTKPLRRFSIATLRDFGVGKRGIKEVSRRRRASSSRPSRARAAPASIPPSS

SEQ ID NO: 771512 - protein, 207 aa, Homo sapiens
APASLQTSPLQGPAGPARWEESGTGRRLTGPTADQARRDPDHGDRDPGIATPRTSSPRPVAPTSPGHSVAESPRPQRASPGGATSIPACRPGHAPPGQRLSPSRDGIGARRSMDPGWGQRDVGWGGLAVILFAALRCSRCSPGCCNYARGLVCWRCGTRGTGARGPRLSRGNPGGSHGGAGAVWRSLLRLRATRGLATAEGARSPGA

SEQ ID NO: 771513 - protein, 142 aa, Homo sapiens
MAAGGSDPRAGDVEEDASQLIFPKEFETAETLLNSEVHMLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 771514 - protein, 85 aa, Homo sapiens
MKITGGLLLLCTVVYFCSSSEAASLSPKKVDCSIYKKYPVVAIPCPITYLPVCGSDYITYGNECHLCTESLKSNGRVQFLHDGSC

SEQ ID NO: 771515 - protein, 166 aa, Homo sapiens
MRNRKAQEREEQNKTQEEHKGGGAGMETAPRGGTRNVETDKHRICDIEDGSGARHEMGIDDNKKRNERERAHEDEKASGDDDERQQSWARVSADARQTENEGRDEQKPKATTTNHNQKKREAAEEERAKDNTENSVRNSGKRKEQRHSGGARLAATPPAKTQQENQ

SEQ ID NO: 771516 - protein, 102 aa, Homo sapiens
MPQHITDYRRPVPITLELRQSSNPRAWTNQSPNAILVDLSPGTPLVIMLHRSGSTHKAETTESFKQGSFNRTMNYLQGIVTKCESKRTLKNTHGAGRGGSRL

SEQ ID NO: 771517 - protein, 42 aa, Homo sapiens
MAAPGAQVPGSRHSRGAWAALPTCSQRLPELPSDKGEPPLPS

SEQ ID NO: 771518 - protein, 124 aa, Homo sapiens
MLLSLQPFLLWPQDKVLIVPYRFTPKDVEPLVCEVGLVTRFNEIHALGLVTESMMELKSSLPPFQPHGLRKTTSQTHLSQEDSTSIFMIRVTKWRLGIVPGSQHTSSPTGWYHQVMATPAPCHK

SEQ ID NO: 771519 - protein, 70 aa, Homo sapiens
APCCQLSCPLGSEQPWCWHQEEPGAQGPLPGGSRQHPQGRKLQLRFLLKPQCASQSSGVSLAGATLLCGT

SEQ ID NO: 771520 - protein, 639 aa, Homo sapiens [sequence omitted]

SEQ ID NO: 771521 - protein, 111 aa, Homo sapiens [sequence omitted]

SEQ ID NO: 771522 - protein, 458 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 771523 - protein, 397 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGEAAPAKPAAPGD

SEQ ID NO: 771524 - protein, 458 aa, Homo sapiens; identical to SEQ ID NO: 771522

SEQ ID NO: 771525 - protein, 615 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGERRGRPQPISEPCLSPFHLTWDQRWQAPARPGAPATSGSEIPGESCGGVCPVSPTVMRVEDSRQPVGALGFQGSGRRTANREALGSWLGQQLHLSCLCSSGHLLMLRGSPPFQRLVPLSWNLAWAYAEAASTPLPQGLGGSIAPTPAAFAHGWPCPPLAQPKSH

SEQ ID NO: 771526 - protein, 458 aa, Homo sapiens; identical to SEQ ID NO: 771522

SEQ ID NO: 771527 - protein, 432 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRGAGTGDRGRGVGAGVRGRGVGGTARLTRGFLLGAAAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGEAAPAKPAAPGD

SEQ ID NO: 771528 - protein, 427 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGRECFPPAPQLPPLDPRPPPRPARRYRAPSAAPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGEAAPAKPAAPGD

SEQ ID NO: 771529 - protein, 379 aa, Homo sapiens
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRGAGTGDRGRGVGAGVRGRGVGGTARLTRGFLLGAAAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCDPTLARGHNVINVIVPESRAHFFQQLGYVLATLLLFILLLVTVLLAARRRRGGEAAPAKPAAPGD

SEQ ID NO: 771530 - protein, 458 aa, Homo sapiens; identical to SEQ ID NO: 771522

SEQ ID NO: 771531 - protein, 390 aa, Homo sapiens
RLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRGGGPGTGFAVAAGDQMLYRSEDIQLGEAVLGHEGTGAAPSRAGKCILGAGTSASSPPTDYKNNILKERAELAHSPLPAKYIDLDKGERRGRPQPISEPCLSPFHLTWDQRWQAPARPGAPATSGSEIPGESCGGVCPVSPTVMRVEDSRQPVGALGFQGSGRRTANREALGSWLGQQLHLSCLCSSGHLLMLRGSPPFQRLVPLSWNLAWAYAEAASTPLPQGLGGSIAPTPAAFAHGWPCPPLAQPKSH

SEQ ID NO: 771532 - protein, 466 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLASSPPTDYKNNILKERAELAHSPLPAKYIDLDKDPSGLCPLGA

SEQ ID NO: 771533 - protein, 411 aa, Homo sapiens
MAGTRLSAESPVPSKPGTQEVVSKRFLNDRKWDSSAIDDPLCGHRSVSLVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGEAAPAKPAAPGD

SEQ ID NO: 771534 - protein, 360 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCDPTLARGHNVINVIVPESRAHFFQQLGYVLATLLLFILLLVTVLLAARRRRGGEAAPAKPAAPGD

SEQ ID NO: 771535 - protein, 458 aa, Homo sapiens; identical to SEQ ID NO: 771522

SEQ ID NO: 771536 - protein, 545 aa, Homo sapiens
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLGEAVLGHEGTGAAPSRAGKCILGAGTSASSPPTDYKNNILKERAELAHSPLPAKYIDLDKGERRGRPQPISEPCLSPFHLTWDQRWQAPARPGAPATSGSEIRCFGPPGAAPPALSLPHPYPSLALSHLDSHWAPCDF

SEQ ID NO: 771537 - protein, 99 aa, Homo sapiens
GRYRPGMYGIEPHAEPPPRGSPGNGSSHSGAPGPDPTLARGHNVINVIVPESRAHFFQQLGYVLATLLLFILLLVTVLLAARRRRGGEAAPAKPAAPGD

SEQ ID NO: 771538 - protein, 211 aa, Homo sapiens
ERLRAEWDKAWGWAGAMALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCACTNAASST

SEQ ID NO: 771539 - protein, 263 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKPRRVEPVCSGLQAQILHCYRDRPHEVLLCSDLVKAYQRCVSAAHKG

SEQ ID NO: 771540 - protein, 67 aa, Homo sapiens
RAAPPGTVSLYLVSRLRKLVMPRRVEPVCSGLQAQILHCYRDRPHEVLLCSDLVKAYQRCVSAAHKG

SEQ ID NO: 771541 - protein, 260 aa, Homo sapiens
GITGIVSKGLGGICLPSTVEAGQRSTFYLLDWQNAEMYKLSSEQFHEAASKMESTIKHKQATLHNPVAALDPGGLCSHGQLHRRLPWTEGKAAQTPAMDGKREGCTNRSAVDGREGCTDSCCGRKGRLPRGLPWTEGKAAAWTAAVDGREGCCPDCRRGRKGRLLPGLPPWTEGKAAARTAAVDGREGCTEPYHQWEGKAARRLAWIEGKGADCLGHEGKATHRIIMDGRKAAQRNVNDEKGRMQSLAIDEKEGCTEAFL

SEQ ID NO: 771542 - protein, 263 aa, Homo sapiens; identical to SEQ ID NO: 771539

SEQ ID NO: 771543 - protein, 263 aa, Homo sapiens; identical to SEQ ID NO: 771539

SEQ ID NO: 771544 - protein, 314 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKVQYFMNSRNTKWRKKYPMTDGFTCEHESPAVSGHLGCSASAFGNISALNVRPRRVEPVCSGLQAQILHCYRDRPHEVLLCSDLVKAYQRCVSAAHKG

SEQ ID NO: 771545 - protein, 232 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTINAGPLHMPLSLGLPRV

SEQ ID NO: 771546 - protein, 80 aa, Homo sapiens
AVSGIKGWLSWAQRGGLSWRRAAPSSWGPSSGAFLSPECTQAPVKEPGVEPHTTACFSVCYIVSLSHPPQGLTLRPSSHF

SEQ ID NO: 771547 - protein, 200 aa, Homo sapiens
VSRGRMLRCINCLQSNSMRQPPSSLRAAGHHCSPTWAVWILCEGLSRMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKPRRVEPVCSGLQAQILHCYRDRPHEVLLCSDLVKAYQRCVSAAHKG

SEQ ID NO: 771548 - protein, 263 aa, Homo sapiens; identical to SEQ ID NO: 771539

SEQ ID NO: 771549 - protein, 367 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKVQYFMNSRNTKWRKKYPMTDGFTCEHESPAVSGHLGCSASAFGNISALNVRANCVTEHVLTGPSWASPAILLPSSQQLCGVGSSPIPDAPTTQWKVTKPAPCPRPRRVEPVCSGLQAQILHCYRDRPHEVLLCSDLVKAYQRCVSAAHKG

SEQ ID NO: 771550 - protein, 229 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAAEIARMRCCCARTWSRHTSAA

SEQ ID NO: 771551 - protein, 420 aa, Homo sapiens
ASPGKRCWPGCSGAGSRVWWLPALRHLAMGSTESSEGRRVSFGVDEEERVRVLQGVRLSENVVNRMKEPSSPPPAPTSSTFGLQDGNLRAPHKESTLPRSGSSGGQQPSGMKEGVKRYEQEHAAIQDKLFQVAKREREAATKHSKASLPTGEGSISHEEQKSVRLARELESREAELRRRDTFYKEQLERIERKNAEMYKLSSEQFHEAASKMESTIKHKQATLHNPVAALDPGGLCSHGQLHRRLPWTEGKAAQTPAMDGKREGCTNRSAVDGREGCTDSCCGRKGRLPRGLPWTEGKAAAWTAAVDGREGCCPDCRRGRKGRLLPGLPPWTEGKAAARTAAVDGREGCTEPYHQWEGKAARRLAWIEGKGADCLGHEGKATHRIIMDGRKAAQRNVNDEKGRMQSLAIDEKEGCTEAFL

SEQ ID NO: 771552 - protein, 113 aa, Homo sapiens
GCSGFVSCTSTSNAHGQEQPEKLDTLFEGFLEVTRQSSLKGPMSWADVAFTGHWKLDTFLPLRALLVADEQRAHLGAWRLRASENTQGGEIKSGIQGPLGGRAWETPRHSVGT

SEQ ID NO: 771553 - protein, 235 aa, Homo sapiens
ESADGRGSSVLPEATATARGVPGEMAEQHGAPEQAAAGKSHGDLGGSYKVILYELENFQGKRCELSAECPSLTDSLLEKVGSIQVESGPWLAFESRAFRGEQFVLEKGDYPRWDAWSNSRDSDSLLSLRPLNIDSPHHKLHLFENPAFSGRKMEIVDDDVPSLWAHGFQDRVASVRAINGTWVGYEFPGYRGRQYVFERGEYRHWNEWDASQPQLQSVRRIRDQKWHKRGRFPSS

SEQ ID NO: 771554 - protein, 235 aa, Homo sapiens; identical to SEQ ID NO: 771553

SEQ ID NO: 771555 - protein, 84 aa, Homo sapiens
QASGLFGALVACLPNSAASPRQEHFLPRLLKLVRGFPTSQKQLHRPPARDLRPQPSTPRLGDLSPPSGPAHHESGPVLGAGMKQ

SEQ ID NO: 771556 - protein, 83 aa, Homo sapiens
QASGLFGALVACLPNSAASPRQEHFLPRLLKLVRGFPTSQKQLHRPPARDLRPQPSTPRLGDLSPPSGPGQGPETCEALSLGV

SEQ ID NO: 771557 - protein, 89 aa, Homo sapiens
QASGLFGALVACLPNSAASPRQEHFLPRLLKLVRGFPTSQKQLHRPPARDLRPQPSTPRLGDLSPPSGPAPSVVTSYIVIHDAKSSLLK

SEQ ID NO: 771558 - protein, 84 aa, Homo sapiens; identical to SEQ ID NO: 771555

SEQ ID NO: 771559 - protein, 83 aa, Homo sapiens; identical to SEQ ID NO: 771556

SEQ ID NO: 771560 - protein, 39 aa, Homo sapiens
NFLPSLTTPQCTSQNLISPRSQALTYISVFCHSITHIQQ

SEQ ID NO: 771561 - protein, 119 aa, Homo sapiens
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 771562 - protein, 80 aa, Homo sapiens
KKDPDGLRQRPFLQRWPGCTYRPGSLIMVVVSKVRDKLMEDLDTEYPRPVRVGGHRGSEVTKMRRGQQGTSKTGHSGSRL

SEQ ID NO: 771563 - protein, 115 aa, Homo sapiens
PLLGPSWLTSPLHNKHVNGSRISYFLVGEFPFLKWGFGSLICTFFFPTSLEKQLGRTGFAGIAGARAKPGHCHHGLQPRLSGPGGERLQQQVSGPRRGSHSELPIYRLFSGRDED

SEQ ID NO: 771564 - protein, 168 aa, Homo sapiens
LPLPKTLKGKKAKGKKVAPAPAVVKKQEAKKVVNSLFEKRRKNFGIGQDIQPKRELTYFVKMARYVRLQQQRAILYKQLKVPPAINQFTQALNCQTVTQLLKLAHKYRPETKQEKKQRLLAQAEKKAAGKGGVPTKRPPALRAGVNTITTLVENKKAQLVVIAHDVDS

SEQ ID NO: 771565 - protein, 153 aa, Homo sapiens
PRGRSCVLLCTDFGGTAKAEQSSPQMMIIPHLLRDKDQRATTATIPEPANAGERKMREFNSVPSQSSGGDATHLPLSLWARLMPGASVDRGHAPGLPKLEKAARLRSEGQNSTVSPTEIKVGAGSVASEALRENPFPGRRGGLHSAACAARLE

SEQ ID NO: 771566 - protein, 592 aa, Homo sapiens
MATCWQALWAYRSYLIVFFVPILLLPLPILVPSKEAYCAYAIILMALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 771567 - protein, 92 aa, Homo sapiens
RPAERGSLCERGLGVAAHYSLRLAEEWMEAPRVKLPRMRWVIREGIGIHPGFSDSKACSKTSAVSSANGDGALGITLYANEISGTFCSGFIN

SEQ ID NO: 771568 - protein, 89 aa, Homo sapiens
PTSFRPGTDGRVLSCVSPSDRQSWPSPAVKGRFKSQLPDLSGLHSYSPGRNSVAGSNPQKPGLGSPGRYSPVHGSQLRRMARLAELAAL

SEQ ID NO: 771569 - protein, 152 aa, Homo sapiens
MPGLTQHRTPGKCPAPSGSSPPWHLQPLCTCSGGFLQHVSCGEPPATLTTGTIGLLARGALSHSEAGSLSVSRTGYHLSVSVVGLDASADSVYWELLIRRFGPEKGYLNKSSTAFIPTRPQQPWIQGWTTHQKLHFLLGVVARACNPTALGG

SEQ ID NO: 771570 - protein, 94 aa, Homo sapiens
ACMHLPYAAASAPQAASRSGKARRRLRTRPHTAPLADMSGYFPAPWRLLGGTLSFTPVCCHGCRALVLMAPGGTYRMPRAERKWEWRRCDIPRC

SEQ ID NO: 771571 - protein, 89 aa, Homo sapiens; identical to SEQ ID NO: 771568

SEQ ID NO: 771572 - protein, 89 aa, Homo sapiens; identical to SEQ ID NO: 771568

SEQ ID NO: 771573 - protein, 89 aa, Homo sapiens; identical to SEQ ID NO: 771568

SEQ ID NO: 771574 - protein, 127 aa, Homo sapiens [sequence omitted]

SEQ ID NO: 771575 - protein, 275 aa, Homo sapiens [sequence omitted]

SEQ ID NO: 771576 - protein, 115 aa, Homo sapiens
NKSKFFSVPGDEGALQNRPRLHLPLSLVAKSLDFYITGKTTQHNAYTHTRACMHTHARTHDAHACTHAHMHTHACARTHHTCTHVHNAHMHTRTHMHTRTRMHTRAHAHTHTEHR

SEQ ID NO: 771577 - protein, 143 aa, Homo sapiens
MIAIVPLAKPSYVAKPGENMGDHYPVIWILILGGNRLQQIVVDLFTISGKSSMFKVVTKDVFGRMCIKSDFITFFRENNHLSIIYVLGSTFVGFKNVCSGETNVIFITNPLNEDLQHPIHVKNIKLVDTTEQSKIFIHRPDIR

SEQ ID NO: 771578 - protein, 79 aa, Homo sapiens
MAVPLLSQWATLQQPLMRTQEGEPTQSPLEVLCSMYRRERRSWVETRAPLRPPRPAPDNADPGPTQQGALHGSCLGEHL

SEQ ID NO: 771579 - protein, 72 aa, Homo sapiens
KKEQEAEQYRLKLEAIARQQPNGVDFTMVEEVAEVDAVVVTEGELEERETKVTGSAGTTEPHTRVSMATVSS

SEQ ID NO: 771580 - protein, 793 aa, Homo sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLALRLWEPSQNIFESYADKNSRLTKWKHTQTHTHLAKKKLFFPPCRCTCLLPGFFSGEVFVNQTDKQAGSLRAGPGVPWQGKLWCRGGHEALEMPFTFSWCFSLWTLLKQRPDKSLQRKGLWAVPEAGWGQDNTAASPGCPLWGPAGGWQRASVSGAAGLAMRVHLQPFGFKDGDGFALPLCPRVGLVGLQLVWELPHGWRWRGFAPCWAPPDCSTECWGWGPAPGGLESSACLGEPLWRGIKTWAPASFSVAEILKSERNGPLLASLLSRGSFGRPPFGEREGRDHSRVCVCSTVGPQAFLLSSPSSSFPLSLSSFPETYVNCMYIPGLLS

SEQ ID NO: 771581 - protein, 79 aa, Homo sapiens
TKTLRARAEAGSKGFDEYMKELGVGIALRKMGAMAKPDCIITCDGKNLTIKTESTLKTTQFSCTGRSRKRQKQEAAEAG

SEQ ID NO: 771582 - protein, 131 aa, Homo sapiens
TKTLRARAEAGSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 771583 - protein, 31 aa, Homo sapiens
MLRGDTPSSLLLQHRAALQGANTGSHSHHSE

SEQ ID NO: 771584 - protein, 115 aa, Homo sapiens
MALGYPQLQDVTSPCRSSHVVIQGDKDCSFLTSELIHYVVREATNQQKFWQKQLLQQFWEQMEKQQVHTFSPSVEKSEETLGDNSEMWDVTPDAGDGVVKPCLEKNHPRPLTHQP

SEQ ID NO: 771585 - protein, 300 aa, Homo sapiens [sequence omitted]

SEQ ID NO: 771586 - protein, 427 aa, Homo sapiens
MVCWQDLEESLRMKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 771587 - protein, 415 aa, Homo sapiens
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 771588 - protein, 253 aa, Homo sapiens [sequence omitted]

SEQ ID NO: 771589 - protein, 415 aa, Homo sapiens; identical to SEQ ID NO: 771587

SEQ ID NO: 771590 - protein, 415 aa, Homo sapiens; identical to SEQ ID NO: 771587

SEQ ID NO: 771591 - protein, 415 aa, Homo sapiens; identical to SEQ ID NO: 771587

SEQ ID NO: 771592 - protein, 152 aa, Homo sapiens
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKVCFQKGLQGCSFVPGSQPMVYPSDAQIPLSGMIPYTFSLFR

SEQ ID NO: 771593 - protein, 361 aa, Homo sapiens
MYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 771594 - protein, 496 aa, Homo sapiens
GAGGPAATPSGSLPPAAARISFQPSFRAFQRPPRTLEARGREGRSSGAAASRQPTSAPPSGALEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 771595 - protein, 318 aa, Homo sapiens
MYGRNELIARYIKLRTGKTRTRKQVSSHIQVLARRKAREIQAKLKFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 771596 - protein, 701 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 771597 - protein, 649 aa, Homo sapiens
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 771598 - protein, 701 aa, Homo sapiens; identical to SEQ ID NO: 771596

SEQ ID NO: 771599 - protein, 669 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 771600 - protein, 701 aa, Homo sapiens; identical to SEQ ID NO: 771596

SEQ ID NO: 771601 - protein, 269 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPGMFYM

SEQ ID NO: 771602 - protein, 105 aa, Homo sapiens
GLDKSFPTTALWKFGAGSFLLWGLCLGGCLAVSKVSTYQMPVVPLLPDVATKNASRCPPKSNVPCGGGIAPGLGTLSYTLFWDLTCIIWLSSHCRHSFPFHLTEK

SEQ ID NO: 771603 - protein, 647 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771604 - protein, 400 aa, Homo sapiens
MDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771605 - protein, 698 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEVGSGGTLGGAGAGDRPRASGPRTLDPPVFPGWVLISSSNLRIFAVPSSLDKAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771606 - protein, 722 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKVKHPSLSMEQSTPNKPCPYLLSTSVPGPGPDPGQAQSGPSVPSRGPVGSRGQGRRGVQSGTVLCPHCPLYCRPVQSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771607 - protein, 647 aa, Homo sapiens; identical to SEQ ID NO: 771603

SEQ ID NO: 771608 - protein, 594 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTLFIHSAFPLPGRRTPRPCSPADLTSGRQSYSWDSSKLP

SEQ ID NO: 771609 - protein, 364 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLAWRMGEAELPRGSR

SEQ ID NO: 771610 - protein, 647 aa, Homo sapiens; identical to SEQ ID NO: 771603

SEQ ID NO: 771611 - protein, 655 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEVGSGGTTRAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771612 - protein, 343 aa, Homo sapiens [sequence omitted]

SEQ ID NO: 771613 - protein, 295 aa, Homo sapiens
FFKLDQTGGPPRELSFTKSSQAVRAVRDMLAVACVNQWEQLRGPGGNEDGPQKLDSEADAEPQDLESTNLLESEAPRDYFLKFAYIVDLDSDTADKFLQLFGTKGVKRVLCPINYPLSPTRFTHCEQVLGEGALDRGTYYWEVEIIEGWVSMGVMAEDFSPQEPYDRGRLGRNAHSCCLQWNGRSFSVWFHGLEAPLPHPFSPTVGVCLEYADRALAFYAVRDGKMSLLRRLKASRPRRGGIPASPIDPFQSRLDSHFAGLFTHRLKPAFFLESVDAHLQIGPLKKSCISVLKRR

SEQ ID NO: 771614 - protein, 418 aa, Homo sapiens
GGALGGRGVMDGSGPFSCPICLEPLREPVTLPCGHNFCLACLGALWPHRGASGAGGPGGAARCPLCQEPFPDGLQLRKNHTLSELLQLRQGSGPGSGPGPAPALAPEPSAPSALPSVPEPSAPCAPEPWPAGEEPVRCDACPEGAALPAALSCLSCLASFCPAHLGPHERSPALRGHRLVPPLRRLEESLCPRHLRPLERYCRAERVCLCEACAAQEHRGHELVPLEQERALQEAEQSKVLSAVEDRMDELGAGIAQSRRTVALIKSAAVAERERVSRLFADAAAALQGFQTQVLGFIEEGEAAMLGRSQGDLRRQEEQRSRLSRARQNLSQVPEADSVSFLQELLALRLALEDGCGPGPGPPRELSFTKSSQAVRAVRDMLAVACVNQWEQLRGPGGNEDGPQKLDSEGGHRPTPPR

SEQ ID NO: 771615 - protein, 256 aa, Homo sapiens
TTTKFAAASTEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVY

SEQ ID NO: 771616 - protein, 178 aa, Homo sapiens
MAFLLKLEPDMQGKVDLFRARIAQEAEDLVSTFFPQKVLELNSRVQELRLQDLSRIHSVPTSEPLATPGNKGDGPNQNLPVLLTQFSIKVPALLGSEGQLLRSNQHLVELTEWVKPEIKLLREKCNTVHMYVHPLILKVQDGNNFRVSIQEDTVDQLWTVDSTAASSLCGFSTYYNTQ

SEQ ID NO: 771617 - protein, 128 aa, Homo sapiens
MQTYAHAQYQRPTTAINETELPILIDQSRPDFKHILLQQNLYTSHLSYTLPSNHALRSYILLISINSYIYNLNTNYNIYMNNLHNKHVKIQTETHTRTCISTLYDPNISHATMTYNLSSTYTNSKDAR

SEQ ID NO: 771618 - protein, 107 aa, Homo sapiens
LSCCRWGVCEVKQDRQGTGEAPVCRGRGVLGASPLAPASFERLISLMWGLVIEAWEPPCPHAALCVSQACPTGLESLPPGPSALLSTVTSFSPFFTGGTPTWREATG

SEQ ID NO: 771619 - protein, 248 aa, Homo sapiens
LLGLLGAPVSISSSDHREKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFYKGTAFL

SEQ ID NO: 771620 - protein, 496 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 771621 - protein, 286 aa, Homo sapiens
MDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRKRIALCCIEGSWRNGLPQLSYVNGYPSDFNAIFSLRAL

SEQ ID NO: 771622 - protein, 378 aa, Homo sapiens
MDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 771623 - protein, 153 aa, Homo sapiens
GSHQLGPIDEMPYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 771624 - protein, 174 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKMESLCCPCWNAMAQSRLTATSPSWFQVILLPQPPK

SEQ ID NO: 771625 - protein, 496 aa, Homo sapiens; identical to SEQ ID NO: 771620

SEQ ID NO: 771626 - protein, 454 aa, Homo sapiens
MDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 771627 - protein, 111 aa, Homo sapiens
MAIKRWKWSSQSKSRSVKCESSWQQVFCLFGFGFGLFVLRWSLLLPPRLEYNGAISAYCNLPIPGSNDSPATASGVAGITGIHHHAQLIFVFLVDTRFYHVGQAGLELLTS

SEQ ID NO: 771628 - protein, 84 aa, Homo sapiens
SRFTSLPTGIEKGIEEHGPGAGAAGQMGRRAGYCKRSRTWGREGLQKAPSTEGESAADSCLARAGGVEQKVDAEQKVDAEQKVD

SEQ ID NO: 771629 - protein, 106 aa, Homo sapiens
MRPSLRLWPRPTGVQCLRSLGRETRAGGDSAEPPCWVGSMTTWWVSSPHALTVNSPVDSFLLVSITPGQAWYNTGRCSQSFQHSTFTGQDGGPRFPSEESESQGAA

SEQ ID NO: 771630 - protein, 66 aa, Homo sapiens
RGERVSSKMWSQQVSHYEDYHGNQGVLLGLKWMRAVLEGAGLMTHGRGLKRMWVVAEDRRVSWNVW

SEQ ID NO: 771631 - protein, 110 aa, Homo sapiens
RERERERERERERERERERGQNPLVAFGVFPWTRPPGRRTSTGWARQAGCAGRKSDELESGRWGATAGLSGEVTLPLRPEWKGAPGGGTAGAEMESHCSPDGVQWRDLGS

SEQ ID NO: 771632 - protein, 44 aa, Homo sapiens
SPWRFSAAYSVGQQVAQDTRQLLSSHNAVLELEQKLVLYEGPWL

SEQ ID NO: 771633 - protein, 144 aa, Homo sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 771634 - protein, 144 aa, Homo sapiens; identical to SEQ ID NO: 771633

SEQ ID NO: 771635 - protein, 144 aa, Homo sapiens; identical to SEQ ID NO: 771633

SEQ ID NO: 771636 - protein, 144 aa, Homo sapiens; identical to SEQ ID NO: 771633

SEQ ID NO: 771637 - protein, 150 aa, Homo sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNRVPSSLETFHPVLNFPLSYPPSLP

SEQ ID NO: 771638 - protein, 144 aa, Homo sapiens; identical to SEQ ID NO: 771633

SEQ ID NO: 771639 - protein, 144 aa, Homo sapiens; identical to SEQ ID NO: 771633

SEQ ID NO: 771640 - protein, 144 aa, Homo sapiens; identical to SEQ ID NO: 771633

SEQ ID NO: 771641 - protein, 150 aa, Homo sapiens; identical to SEQ ID NO: 771637

SEQ ID NO: 771642 - protein, 289 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKSMSCVLLISSVNEGKWSQVLSLWG

SEQ ID NO: 771643 - protein, 403 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 771644 - protein, 403 aa, Homo sapiens; identical to SEQ ID NO: 771643

SEQ ID NO: 771645 - protein, 299 aa, Homo sapiens
MADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 771646 - protein, 192 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPSFR

SEQ ID NO: 771647 - protein, 348 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 771648 - protein, 312 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGTLWILMPRVWLDCHLVDTESRVPLCSSTRTSVMRRLLRLRCSASKRPTFQSITPLASCLHALAGAFSITEPRGMLRLMHLESFFLVFPYSASLEMEKLDVIG

SEQ ID NO: 771649 - protein, 163 aa, Homo sapiens
MADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKSK

SEQ ID NO: 771650 - protein, 103 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELETRFRFCQLSQ

SEQ ID NO: 771651 - protein, 299 aa, Homo sapiens; identical to SEQ ID NO: 771645

SEQ ID NO: 771652 - protein, 299 aa, Homo sapiens; identical to SEQ ID NO: 771645

SEQ ID NO: 771653 - protein, 297 aa, Homo sapiens
AFSRIPVGCKCRGRKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEVKDDDLFHSYTTIMALIHLGSSK

SEQ ID NO: 771654 - protein, 381 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKNPLDIDASGVVGLSFSGHRIQSATVLLNEDVSDEKTAEAAMQRLKAANIPEHNTIGFMFACVGRGFQYYRAKGNVEADAFRKFFPSVPLFGFFGNGEIGCDRIVTGNFILRKCNEV

SEQ ID NO: 771655 - protein, 267 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQVDNLSSLTSEKSK

SEQ ID NO: 771656 - protein, 134 aa, Homo sapiens
MGKPTGTESPKEVPNPVGSGKGFREGCLQILMTKSNIFAVVTQEEMNGWLEAVASSVAEHAEIARWGQTLPTTSSTDEGTLRGKAEIAGPAGAGSDFPPPGPDTSRLPSFPHCGHKDTFSSAGAGAPSSNTEDA

SEQ ID NO: 771657 - protein, 114 aa, Homo sapiens
MGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 771658 - protein, 181 aa, Homo sapiens
MSPRDRHSGLLGTAAAHSHQELEDLGVSRIGHQELNLERQLTLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVVSILGFILIFIRGYFLVQLEEVN

SEQ ID NO: 771659 - protein, 183 aa, Homo sapiens
MSPRDRHSGLLGTAAAHSHQELEDLGVSRIGHQELNLERQLTLLCALNYGLETENLKTLSHKLNASAKNLQNFITGRRRSGHYDGRTSRKLPNDFLTSVVDLIGAAKSLLAWLDRSPFAAVTDYSVTRNNVIQLCLELTTIVQQDCTVYETENKILHVCKTLSGVCDHIISLSSDPLVSQSAH

SEQ ID NO: 771660 - protein, 501 aa, Homo sapiens
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPAALLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 771661 - protein, 501 aa, Homo sapiens; identical to SEQ ID NO: 771660

SEQ ID NO: 771662 - protein, 277 aa, Homo sapiens
MWSPTMAGGLFAVSKKYFEYLGSYDTGMEVWGGENLEFSFRIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERML

SEQ ID NO: 771663 - protein, 76 aa, Homo sapiens
CTSLVLCPRDSPELLRYTEDTYPSINISEMDGSLFHEQSKKCVQAARKESSDSFVPLLRDCTNSDHQKWFFKERML

SEQ ID NO: 771664 - protein, 515 aa, Homo sapiens
RPPVPANALGARGEAVRLQLQGEELRLQEESVRLHQINIYLSDRISLHRRLPVRWNPLCKEKKYDYDNLPRTSVIIAFYNEAWSTLLRTVYSVLETSPDILLEEVILVDDYSDREHLKERLANELSGLPKVRLIRANKREGLVRARLLGASAARGDVLTFLDCHCECHEGWLEPLLQRIHEEESAVVCPVIDVIDWNTFEYLGNSGEPQIGGFDWRLVFTWHTVPERERIRMQSPVDVIRSPTMAGGLFAVSKKYFEYLGSYDTGMEVWGGENLEFSFRIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERML

SEQ ID NO: 771665 - protein, 563 aa, Homo sapiens
RPPVPANALGARGEAVRLQLQGEELRLQEESVRLHQINIYLSDRISLHRRLPVRWNPLCKEKKYDYDNLPRTSVIIAFYNEAWSTLLRTVYSVLETSPDILLEEVILVDDYSDREHLKERLANELSGLPKVRLIRANKREGLVRARLLGASAARGDVLTFLDCHCECHEGWLEPLLQRIHEEESAVVCPVIDVIDWNTFEYLGNSGEPQIGGFDWRLVFTWHTVPERERIRMQSPVDVIRSPTMAGGLFAVSKKYFEYLGSYDTGMEVWGGENLEFSFRIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLPTRLAPKFPGNSQFQGNNTVGVFPFFPKKKGGKRGPCVRPKKFVVCGASILEKTLFFSAAGNKNNR

SEQ ID NO: 771666 - protein, 515 aa, Homo sapiens; identical to SEQ ID NO: 771664

SEQ ID NO: 771667 - protein, 315 aa, Homo sapiens
MDFGVLVPTAYMFWGLLSCSLPTFCVMSVPGRWPPARWRLSILAVSIMPCVCLASLLQILWTRSSSPAHHLASPFLCVQIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERML

SEQ ID NO: 771668 - protein, 86 aa, Homo sapiens
GSLCRRVQKFICRRMDLYFTNSPRNVSRLRGRSRVTVSFHSYETAPTRIIRNGSSKSACYEASCIKEPIEGDCGARTLPNKDLAKQ

SEQ ID NO: 771669 - protein, 69 aa, Homo sapiens
MAQDLSEKDLLKMEVEQLKKEVKNTRIPISKAGKEIKEYVEAQAGNDPFLKGIPEDKNPFKEKGGCLIS

SEQ ID NO: 771670 - protein, 77 aa, Homo sapiens
RPRFGTRLGECALLWQDQVCLGQDGPGSQREGPVEDGGGAAEERSEKHKNSDFQSGKGNQGVRGGPSRKRSFSQRHP

SEQ ID NO: 771671 - protein, 69 aa, Homo sapiens; identical to SEQ ID NO: 771669

SEQ ID NO: 771672 - protein, 152 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQLHVSFSLRKKKAGHQ

SEQ ID NO: 771673 - protein, 140 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQGHQ

SEQ ID NO: 771674 - protein, 140 aa, Homo sapiens; identical to SEQ ID NO: 771673

SEQ ID NO: 771675 - protein, 211 aa, Homo sapiens
MSPEAMGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQRTLTTSFHSLMAYKVSAEKSTDILMDIPLDTNELCLPSVHSQHLHSEDLLKAHESSQSLSGSCFTWRHLVSHLQ

SEQ ID NO: 771676 - protein, 136 aa, Homo sapiens
HTARVHLHVVIKGELLACPDGSCGKESDATQPLVKVVYDDLLHQHVEHTLSETEPGRTRHRAKILPFALRSRERRWPGNPAQQLCAQCPRPPSSTSPAAGLRWGSVCFGDGGLIFLPGGSAVVLRRGDRHTQPSLM

SEQ ID NO: 771677 - protein, 198 aa, Homo sapiens
SLKAGKGPFPGSSSEGVSFYSAFLFHCASNGLDEAHPREGGKSASLGVPSSMLISSRNTVSHTQNHVGPDIWAPHGPVKSTHTVNHHPQQLKKKISSLSQTSRLLCPQLLMSLDFRDFGNSFLGSSTLSSRLGSAWLRTVFSRWERTPVSLETLVSIPPKKCSVKSVLSQISTQFSALPENFSQHGGWRHLREARLGP

SEQ ID NO: 771678 - protein, 102 aa, Homo sapiens
MALYLGLGRGLHSQAAKEPLPISLGSSGGPDMILFQTYISHFVFLPERVRALPPSGICPPHRLPGCGLLWLQSRCQPLAFILLSGQMAALLQPCPPGKERPP

SEQ ID NO: 771679 - protein, 187 aa, Homo sapiens
VRTGRTRRRPGSGGDRYPYRWGRLEERNLHEFEQLGFPTTSKSWKTQGAGRAPGAMASPSGSSEAPGKPRGRDGRPRREEDDVPPEEKRLRLLLEGGSAQPQDCEDGQDAPRSARKETGTQTGGEAEDFYGNTLFEEPMKQCQAGTRISSDFFEEEIRFFTHRSCLSGSRRTEGPFMRFCLRRPLAW

SEQ ID NO: 771680 - protein, 76 aa, Homo sapiens
ESRNQSLCYNERQLWLTVESLLVDYSIRIISEQFLILDWLLSDFQVITKEKKKRHYVFPLESQYGLFVPTKIHVEI

SEQ ID NO: 771681 - protein, 643 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKRETLERTAPRVTQAKRVTLDHLLQELRENLGNLVVQGKRVNQGFLGFLDFLGIKGEPGFIGPQGEPGLPGLPGTKGERGEAGPPGRGERGEPGAPGPKGKQGESGTRGPKGSKGDRGEKGDSGAQGPRGPPGQKGDQGATKIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 771682 - protein, 287 aa, Homo sapiens
MVDEAVYVSTRRPQVNEVERRRGESGPPGPPGPKGDKGEQGDQGPRGLPGFPTVAALHSNQILTVKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPVEQGEKGDAGENGPKGDTGEKGDPGSSAAGIKGEPGESGRPGQKGEPGFIGPQGEPGLPGLPGTKGERGEAGPPGRGERGEPGAPGPKGIREEKGALELRDKGPLAKQGQEPLDLRYTQLPKTPRYPF

SEQ ID NO: 771683 - protein, 198 aa, Homo sapiens
MGCPLMTMPGPPGKRGKRGRRGESGPPGQPGPQGPPGPKGDKGEQGDQGPRGLPGFPTVAALHSNQILTVKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPRVTQAKKGDLDHLLQELREN

SEQ ID NO: 771684 - protein, 642 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPVEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATKIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 771685 - protein, 654 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPVEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATKIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 771686 - protein, 176 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGSLGPPGRKGLL

SEQ ID NO: 771687 - protein, 165 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRN

SEQ ID NO: 771688 - protein, 134 aa, Homo sapiens
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 771689 - protein, 134 aa, Homo sapiens; identical to SEQ ID NO: 771688

SEQ ID NO: 771690 - protein, 134 aa, Homo sapiens; identical to SEQ ID NO: 771688

SEQ ID NO: 771691 - protein, 134 aa, Homo sapiens; identical to SEQ ID NO: 771688

SEQ ID NO: 771692 - protein, 141 aa, Homo sapiens
SLTLAGKALLLEALSQKLDEEAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 771693 - protein, 134 aa, Homo sapiens; identical to SEQ ID NO: 771688

SEQ ID NO: 771694 - protein, 192 aa, Homo sapiens
MAVSRKDWSALSSLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTARS

SEQ ID NO: 771695 - protein, 517 aa, Homo sapiens
MAVSRKDWSALSSLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTAPEKSLVSDKTSISEKVLASEKTSLSEKIAVSEKRNSSEKKSVLEKTSVSEKSLAPGMALGSGRRLVSEKASIFEKALASEKSPTADAKPAPKRATASEQPLAQEPPASGGSPATTKEQRGRALPGKNLPSLAKQGASDPPTVASRLPPVTLQVKIPSKEEEADMSSPTQRTYSSSLKRSSPRTISFRMKPKKENSETTLTRSASMKLPDNTVKLGEKLERYHTAIRRSESVKSRGLPCTELFVAPVGVASKRHLFEKELAGQSRAEPASSRKENLRLSGVVTSRLNLWISRTQESGDQDPQEAQKASSATERTQWGQKSDSSLDAEV

SEQ ID NO: 771696 - protein, 226 aa, Homo sapiens
SDGPPSACGLAAGPAWAAINAALSGTKPNFRGPFPGLEIRTSARGAHLARQRTLEDEEEQERERRRRHRNLSSTTDDEAPRLSQNGDRQASASERLPSVEEAEVPKPLPPASKDEDEDIQSILRTRQERRQRRQVVEAAQAPIQERLEAEEGRNSLSPVQATQKPLVSKKELEIPPRRRLSREQRGPWALEEESLVGREPEERKKGVPEKSPVLEKSSMPKKTARS

SEQ ID NO: 771697 - protein, 67 aa, Homo sapiens
GSAVGVLGSQRSESVKSRGLPCTELFVAPVGVASKRHLFEKELAGQSRAEPASSRKVRGSGPTGSLG

SEQ ID NO: 771698 - protein, 146 aa, Homo sapiens
ASLRSCSAAVGHRVSWFCIQFQRSVALRGSRSKMQLDFDLAIQIFRPVSPGFQGCVSWSCKPNDHTRSGLKQQRFILTALEARSPNSRCGRGWFLPEALREPRSQAPPGARWWPGSRVLPASWTHGSNLCSLLPICMFSFSCQESS

SEQ ID NO: 771699 - protein, 104 aa, Homo sapiens
LALSPRLECSGAISAHYNLRLPGSSNSHGASASLVAETADVYHHAWLIFVFLVEMGSCHVGQASLKLLTSCDLLRLVDQSAEITDMSHHGCPKPSLFLMPFFKF

SEQ ID NO: 771700 - protein, 185 aa, Homo sapiens
ASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGPYDSNQPHRKTKITFEEDKVDSALIGSSSHVEWEDAVHIIPGSSMIYILKLSENVFMIKFSLNVLPGTLQRQCCEFPTSAHLRAEKV

SEQ ID NO: 771701 - protein, 225 aa, Homo sapiens
HPFYSTGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEDWLGLHLYIVERANPGFIYQVEAFDPEDTSRNIPLSYFLISPPKSFRMSANGTLFSTTELDFEAGHRSFHLIVEVRDSGGLKASTELQVNIVNLND

SEQ ID NO: 771702 - protein, 127 aa, Homo sapiens
WILQNPGRVSQTYLQTPLSFPQVYIAIYIRQYSQNIFMEYIWGHLNDCLLTALPFGVSAALSDAPETLQTLDLDSPAPRLPLVFPLSIQSCRPETSVILLTLPSPPSHIPKSITSSRDFKKEQLYCT

SEQ ID NO: 771703 - protein, 333 aa, Homo sapiens
RIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 771704 - protein, 76 aa, Homo sapiens
EWKPAATQKPVRRRRRGLQQPDGGYNPDGRQQRRRRSVALHALEHNPAMKKEEALTQATAWTHLQDARLNETLQAQ

SEQ ID NO: 771705 - protein, 194 aa, Homo sapiens
DCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 771706 - protein, 199 aa, Homo sapiens
TSLPSRPWKLVDPRISAFRLPKVPRSPPTALAAAQPQRLWLEIEILWNQPLDALDWGGTRFHCLESSTFSDLSLCGAPGLRSEKCALGHRQQRRRRKEQLSLRPLTTRAGWGGLAGVGLLHFPSWDPLPELAWGPGRGTRGASFSPQAPPDVGKANNRGNAEKQKAIRHDLSRLRREISVGRVRGEGQERARGGGSREI

SEQ ID NO: 771707 - protein, 113 aa, Homo sapiens
MRFAKKHKKKGLKKMHTNNAKAMSPRAEALKALVKPKEVKPKIPKGVSHKLDRLAYIAHPNLGKLARARMAKGLRLCRPKAKAKDQTKAQAAAPASVSAQAPKAAQCPTKTSE

SEQ ID NO: 771708 - protein, 39 aa, Homo sapiens
MPRCEGQMKGMLLERCLLRLLRISGLCPDGRSTIKAQNF

SEQ ID NO: 771709 - protein, 39 aa, Homo sapiens; identical to SEQ ID NO: 771708

SEQ ID NO: 771710 - protein, 180 aa, Homo sapiens [sequence omitted]

SEQ ID NO: 771711 - protein, 103 aa, Homo sapiens
IELVVFLPALCCKMGVPYCIIKGKARLGRLVHRKTCTTVAFTQVNLEDKGALAKLVEGIRTNDNDRYDEICCHWGGNILGPKSVACIAKLEKAKAKELATKLG

SEQ ID NO: 771712 - protein, 146 aa, Homo sapiens [sequence omitted]

SEQ ID NO: 771713 - protein, 134 aa, Homo sapiens
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNVRKLAWFLQNTEGLTHLCLWH

SEQ ID NO: 771714 - protein, 279 aa, Homo sapiens
HLRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 771715 - protein, 243 aa, Homo sapiens
EFPTMQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTACLLQSELVNYERVREYCLKVLEKQQGNFKATYRAGIAFYHLGDYARALRYLQEARSREPTDTNVLRYIQLTQLKMNRCSLQREDSGAGSQTRDVIG

SEQ ID NO: 771716 - protein, 172 aa, Homo sapiens
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPGPRAHQQPRAGAPQRGAAAPGGEHGGGVLRLPHGYAVGGWGDGARGEGAIGRAWRLGGQGPWG

SEQ ID NO: 771717 - protein, 257 aa, Homo sapiens
SGFSAPSQLWCGRPPLWLRVAEAAWRRRRRWGELSVAAAAGGGLVGLVCYQLYGDPRAGSPATGRPSKSAATEPEDPPRGRGMLPIPVAAAKETVAIGRTDIEDLDLYATSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLVRILYSS

SEQ ID NO: 771718 - protein, 153 aa, Homo sapiens
AGSLPPPSSGVGGLRYGCAAKALVAATPGVSSTLRSPAPPWAVGAACGDHPSKSAATEPEDPPRGRGMLPIPVAAAKETVAIGRTDIEDLDLYATSRERRFRLFASIECEGQLFMTPYDFILAVTTDEPKGIKSNARRNTTSLERLIEAISKS

SEQ ID NO: 771719 - protein, 305 aa, Homo sapiens
RVLCPLPALVWAASAMAALRRLLWPPPRVSPPLCAHQPLLGPWGRPAVTTLGLPGRPFSSREDEERAVAEAAWRRRRRWGELSVAAAAGGGLVGLVCYQLYGDPRAGSPATGRPSKSAATEPEDPPRGRGMLPIPVAAAKETVAIGRTDIEDLDLYATSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLVRILYSS

SEQ ID NO: 771720 - protein, 114 aa, Homo sapiens
TNEDAVYDIANEDVVYDIANEDALQDIANEVAVYDIANEDIVYDIANEDALYDITNEDAVYNIANEDAVYGIANEDAVYEFANKDAVYDIANEDTVQDICKKEDAANVRHFSLS

SEQ ID NO: 771721 - protein, 605 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKARVANQDLQVQLDQALQQALDPNSKGNSLFAEVEDRRAAMERQLISMKVKYQSLKKQNVFNREQMQRMKLQIATLLQMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIHTPVVSLSPHKNLPVDMQLKKEKKCVKLIGVPADAEALSERSGNTPNSPRLAAESKLQTEVKEGKETSSKLEKETCKKSHPILYVSSKSTPETQCPQQ

SEQ ID NO: 771722 - protein, 508 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMSMKVKYQSLKKQNVFNREQMQRMKLQIATLLQMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIHTPVVSLSPHKNLPVDMQLKKEKKCVKLIGVPADAEALSERSGNTPNSPRLAAESKLQTEVKEGKETSSKLEKETCKKSHPILYVSSKSTPETQCPQQ

SEQ ID NO: 771723 - protein, 597 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKARVANQDLQVQLDQALQQALDPNSKGNSLFAEVEDRRAAMERQLISMKVKYQSLKKQNVFNREQMQRMKMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIHTPVVSLSPHKNLPVDMQLKKEKKCVKLIGVPADAEALSERSGNTPNSPRLAAESKLQTEVKEGKETSSKLEKETCKKSHPILYVSSKSTPETQCPQQ

SEQ ID NO: 771724 - protein, 605 aa, Homo sapiens; identical to SEQ ID NO: 771721

SEQ ID NO: 771725 - protein, 605 aa, Homo sapiens; identical to SEQ ID NO: 771721

SEQ ID NO: 771726 - protein, 102 aa, Homo sapiens
SSSPLCRWETEARRSRRSGARSRRTPAPHRRADALCAELPAIGSAPTGLGTEGQRMLPPSRWQECPSPFSLELRVCASLGVKGRPRCDGRLCSVLGAKPGSG

SEQ ID NO: 771727 - protein, 92 aa, Homo sapiens
SLHLSPMLNASFPRTSDSGFFSFGTQTGFQLADSLLWNLVIVIYLEVLRKIRHQSEKSSYQNTINSAKRQARRNIKFMVKLGGKNDEIIDTL

SEQ ID NO: 771728 - protein, 30 aa, Homo sapiens
EEKHRCCGKTDERPRPITVVVVRDASQRRR

SEQ ID NO: 771729 - protein, 127 aa, Homo sapiens
RESRPAISQAHTVSPARPWMLHLILTAGLPCRWKCPVSQRAHIHLELTAHKWLMLEVQGGLGKQMRPPHSYLDLAATVPGDCSRPNGRVIGVCAHCLYPQQPPLPLFSLALPLHPLPSSLGRRNETG

SEQ ID NO: 771730 - protein, 525 aa, Homo sapiens
QKGAATGKQALHCIRMSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 771731 - protein, 543 aa, Homo sapiens
QKGAATGKQALHCIRMSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 771732 - protein, 87 aa, Homo sapiens
MGPLEWREFQRVLAGVGPLRHGSAADMLACIECGELSVENFCGFGKCIMSCIHHHRIMQNSFTAFKKIPGWAQWLMLVIPALCEARA

SEQ ID NO: 771733 - protein, 138 aa, Homo sapiens
MDTTELLGGFEQVDLIRPWRRLLEKVEGTVRALLRDSLLISADDAEVVLRAWSHFLLTYKPKCLGEGGKAITMEIVNKLEAVLLLMQRLNNKINSYCKAEFAKLVEEFRSFGVKLTQLASGHSHGTFEWVDSMLVQAL

SEQ ID NO: 771734 - protein, 63 aa, Homo sapiens
SASTCTHIQAGHKAAGRSTSDHNQKSWPLTTHLSASGSQGPSMGGTPHENYPNAQVPANAHKP

SEQ ID NO: 771735 - protein, 97 aa, Homo sapiens
GSVTSTPGPIFYPKFLAVPAVTLGLSIWISHEQFKHNMSKTKSTIFQKQPTPLPPLPTSLTRITTFHNKDMTIGYPCAQPWGGFLRCTQLPPRCVVF

SEQ ID NO: 771736 - protein, 246 aa, Homo sapiens
MDVNSSGHPDLYGRLCSFLLPEVGGRLPDLSPDGGAEPVAVSGTPHLLSGGPRGDGQPGAHLGRNPGQCLRPRGANQERAEKVVIGSVLTLISLRSRATAWWYLRVLLKKLRQPSNYLIVSMALANLSVAMAVMPFISVTDLIGGKWIFGHFFCNVFSMNVMCCTAWILTLYVISIDRYLGIMKPLTYPMRQKGKCMTKMILSVCLLSAFVTLPTIFGRAQNVNDDKVCLVSQDFGYTIYSTAVAS

SEQ ID NO: 771737 - protein, 38 aa, Homo sapiens
MVEPTSRFYHTINIFTITILITFTITIYIITILITVTT

SEQ ID NO: 771738 - protein, 81 aa, Homo sapiens
PRPTAGGNSSSSQDRFRALRTQGHTQATQVGLQMWGSPCWSQAGWHWHGTWGISPRLGSQDASCSLSSIPPLPLPEAPGYF

SEQ ID NO: 771739 - protein, 38 aa, Homo sapiens
RRTELFITTALTLELRPWNSGPGLFALHQTDVSPQVLL

SEQ ID NO: 771740 - protein, 47 aa, Homo sapiens
LPNYPVKHYPHYLHFSDEGSWLRINQNLRRLKVSDWHSHGKGPWTDF

SEQ ID NO: 771741 - protein, 132 aa, Homo sapiens
RPLGGDLLPRSTLPARVLSAASTFHPAPAFGATVAAFHRRAALRAPEPAMSGPNGDLGMPVEAGAEGEEDGFGEAEYAAINSMLDQINSCLDHLEEKNDHLHARLQELLESNRQTRLEFQQQLGEAPSDASP

SEQ ID NO: 771742 - protein, 132 aa, Homo sapiens; identical to SEQ ID NO: 771741

SEQ ID NO: 771743 - protein, 132 aa, Homo sapiens; identical to SEQ ID NO: 771741

SEQ ID NO: 771744 - protein, 82 aa, Homo sapiens
RPLGGDLLPRSTLPARVLSAASTFHPAPAFGATVAAFHRRAALRAPEPAMSGPNGDLGMPVEAGAEGEEDGFGEAERYNLLG

SEQ ID NO: 771745 - protein, 132 aa, Homo sapiens; identical to SEQ ID NO: 771741

SEQ ID NO: 771746 - protein, 82 aa, Homo sapiens; identical to SEQ ID NO: 771744

SEQ ID NO: 771747 - protein, 78 aa, Homo sapiens
VRAAGHQSRFTDGETKAASGTLALVGLAPPLPSVLGETEAPEGGRVELSGGAGPGRGVGDAGASLCRFSIPSHPALLV

SEQ ID NO: 771748 - protein, 132 aa, Homo sapiens; identical to SEQ ID NO: 771741

SEQ ID NO: 771749 - protein, 39 aa, Homo sapiens
MGKHNSTQMSKPGDLSKPGDLSKPGDLSKPGDLSKPGDL

SEQ ID NO: 771750 - protein, 82 aa, Homo sapiens; identical to SEQ ID NO: 771744

SEQ ID NO: 771751 - protein, 78 aa, Homo sapiens; identical to SEQ ID NO: 771747

SEQ ID NO: 771752 - protein, 387 aa, Homo sapiens
RACLESHGRQPSTGLAPQLSLVYFSGVTSVPSFKGGALSLWVICTDCAKKAFVLQMSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 771753 - protein, 332 aa, Homo sapiens
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 771754 - protein, 387 aa, Homo sapiens; identical to SEQ ID NO: 771752

SEQ ID NO: 771755 - protein, 332 aa, Homo sapiens; identical to SEQ ID NO: 771753

SEQ ID NO: 771756 - protein, 759 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 771757 - protein, 759 aa, Homo sapiens; identical to SEQ ID NO: 771756

SEQ ID NO: 771758 - protein, 684 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKEQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKQKLLGPSKGAPLAKRSKWFDS

SEQ ID NO: 771759 - protein, 732 aa, Homo sapiens [sequence omitted]

SEQ ID NO: 771760 - protein, 602 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLVQKLNG

SEQ ID NO: 771761 - protein, 376 aa, Homo sapiens
GGWSGEEKGIPTCGTLGGPRGRRLPIDCGRCKGRSLWRLVGVLGSAGGGRGVSECERGTGIPNLRASRLWRRGGRAQAAMRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771762 - protein, 422 aa, Homo sapiens
GGWSGEEKGIPTCGTLGGPRGRRLPIDCGRCKGRSLWRLVGVLGSAGGGRGVSECERGTGIPNLRASRLWRRGGRAQAAMRDRTHELRQGDDSSDEEDKERVALVVHPGTARLGSPDEEFFHKVRTIRQTIVKLGNKVQELEKQQVTILATPLPEESELKPRLQGACSAPGIVGVVVPRRWWPEWFVEVGAAVWESLAFSYSGMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771763 - protein, 376 aa, Homo sapiens; identical to SEQ ID NO: 771761

SEQ ID NO: 771764 - protein, 176 aa, Homo sapiens
MRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771765 - protein, 376 aa, Homo sapiens; identical to SEQ ID NO: 771761

SEQ ID NO: 771766 - protein, 396 aa, Homo sapiens
GGWSGEEKGIPTCGTLGGPRGRRLPIDCGRCKGRSLWRLVGVLGSAGGGRGVSECERGTGIPNLRASRLWRRGGRAQAAMRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQVEFKKSGRGTSLGNTEEKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771767 - protein, 156 aa, Homo sapiens
MLSEVSYTRLLPNILLRNRTGSSHDSMAAGRLEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771768 - protein, 377 aa, Homo sapiens
GGWSGEEKGIPTCGTLGGPRGRRLPIDCGRCKGRSLWRLVGVLGSAGGGRGVSECERGTGIPNLRASRLWRRGGRAQAAMRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKVSLPGPATAPGTLCDFPDPLLSHRRKS

SEQ ID NO: 771769 - protein, 348 aa, Homo sapiens
GGWSGEEKGIPTCGTLGGPRGRRLPIDCGRCKGRSLWRLVGVLGSAGGGRGVSECERGTGIPNLRASRLWRRGGRAQAAMRDRTHELRQGDDSSDEEDKERVALVVHPGTARLGSPDEEFFHKVRTIRQTIVKLGNKVQELEKQQVTILATPLPEETQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771770 - protein, 183 aa, Homo sapiens
GPVLAGIRMKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 771771 - protein, 377 aa, Homo sapiens; identical to SEQ ID NO: 771768

SEQ ID NO: 771772 - protein, 377 aa, Homo sapiens; identical to SEQ ID NO: 771768

SEQ ID NO: 771773 - protein, 1061 aa, Homo sapiens
AGQCFWALCCSCLSVARRWDAPPEGCGAQVASSGWTAPGRGRGHRGRPGLREAMEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHRSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771774 - protein, 1026 aa, Homo sapiens
SVLGRAQRRRRSTDSLCVHSIWKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHRSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771775 - protein, 928 aa, Homo sapiens
FKFSENYIWFNAIFINSDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHRSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771776 - protein, 548 aa, Homo sapiens
AGQCFWALCCSCLSVARRWDAPPEGCGAQVASSGWTAPGRGRGHRGRPGLREAMEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHRSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKVDSGDSVV

SEQ ID NO: 771777 - protein, 247 aa, Homo sapiens
AGQCFWALCCSCLSVARRWDAPPEGCGAQVASSGWTAPGRGRGHRGRPGLREAMEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQY

SEQ ID NO: 771778 - protein, 582 aa, Homo sapiens
ISAHCNLHFLDSSDSSASASRVAGTTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771779 - protein, 127 aa, Homo sapiens
DPREAIGAEDESHSVTRLECNGTNLAYCNLRLQGSRDSPASVSRAIQSGGSKEERKHREKKLRKESEMDLPEHKEPRCRDPDQDARSRDRVAEVHTAKESPRGERDRDRQRERRRDAKGKKGLLTGF

SEQ ID NO: 771780 - protein, 962 aa, Homo sapiens
MDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKLQYGDSKDNPLKYWLYKEEGERRHRKPREPDRDKKHREKSSTREKREKYSKEKSNSFSDKGEERHKEKRHKEGFHFDDERHRSNVDRKEKSAKDEPRKRESQNGEHRNRGASSKRDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSRRNVRFVFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771781 - protein, 830 aa, Homo sapiens
MCSCVSQLVVFYSCSTETARTTLSSTGFIKKKARGDTGSPESQIETRNTEKKAAQGKKERNIPKRKVIHSLTKGKKDIKKSDTKKVFILMMRGTEATWIEKRNRQKMSPGKGNPRMVNTEIEVQAQKEDGTSSQHAENLVRNHGKDKDSRRKHGHEEGSSVWWKLDQRPGGEETVEIEKEETDLENARADAYTASCEDDFEDYEDDFEVCDGDDDESSNEPESREKLEELPLAQKKEIQEIQRAINAENERIGELSLKLFQKRGRTEFEKEPRTDTNSSPSRASVCGIFVDFASASHRQKSRTQALKQKMRSTKLLRLIDLDFSFTFSLLDLPPVNEYDMYIRNFGKKNTKQAYVQCNEDNVERDIQTEEIETREVWTQHPGESTVVSGGSEQRDTSDAVVMPKIDTPRLCSFLRAACQVMAVLLEEDRLAAEPSWNLRAQDRALYFSDSSSQLNTSLPFLQSHVLLLEPFESIFTVCRNSARLSCRLGFERRLKAALLCDAERWLLDVPDRHVFHRWNPYLSKPPKPSSSSRTYLNVRPQKAELCAFTLFYSEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 771782 - protein, 334 aa, Homo sapiens
AGQCFWALCCSCLSVARRWDAPPEGCGAQVASSGWTAPGRGRGHRGRPGLREAMEPGKRRTKDDTWKADDLRKHLWAIQSGGSKEERKHREKKLRKESEMDLPEHKEPRCRDPDQDARSRDRVAEVHTAKESPRGERDRDRQRERRRDAKDREKEKLKEKHREAEKSHSRGKDREKEKDRRARKEELRQTVAHHNLLGQETRDRQLLERAERKGRSVSKVRSEEKDEDSERGDEDRERRYRERKRRTKDDTWKADDLRKHLWAIQSGGSKEERKHREKKLRKESEMDLPEHKEPRCRDPDQDARSRDRVAEVHTAKESPRGERDRDRQRERRRD

SEQ ID NO: 771783 - protein, 166 aa, Homo sapiens
LGSASGPSAAPACRLLGAGTRLPKGAGHRWPLRGGPRLAGAEDTAAARACGKRWSPGRSVRRWVWARGGRASRTPSGAASSAAAALPLRSGSLGRAGASRRSRGASEAGRETEARLAVGARDGRTPGSRRSGEAVCAASGLGSPPRPVSSRPAWRRPRPLLRGRGG

SEQ ID NO: 771784 - protein, 2689 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAMECPAGTIYQSCMTPCPASCANLADPGDCEGPCVEGCASIPGYAYSGTQSLPWLTVAAPAMASTTSWAAAF

SEQ ID NO: 771785 - protein, 2812 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGHGVSSRYHISELYDTLPSILCQPGRPRGLRGPLRGRLRQHPRLCLQWHPEPPLADCGCTSNGIYYQLGSSFLTEDCSQRCTCASSRILLCEPFSCRAGEVCTLGNHTQGCFPESPCLQNPCQNDGQCREQGATFTCECEVGYGGGLCMEPRDAPPPRKPASNLVAVLLGLLVPVVVVLLAVTRECIYRTRRKREKTQEGDRLARLVDTDTVLDCAC

SEQ ID NO: 771786 - protein, 2601 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGWAAAF

SEQ ID NO: 771787 - protein, 2724 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAMECPAGTIYQSCMTPCPASCANLADPGDCEGPCVEGCASIPGYAYSGTQSLPWLTVAAPAMASTTRSELAAGGPGEQRRQGEPDQGWNWNVSSWPFPFLAGQQLSD

SEQ ID NO: 771788 - protein, 2624 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCAGQQLSD

SEQ ID NO: 771789 - protein, 2721 aa, Homo sapiens
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLRCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGYAILCQEAGAALAGWRDRTLCESPCLQNPCQNDGQCREQGATFTCECEVGYGGGLCMEPRDAPPPRKPASNLVAVLLGLLVPVVVVLLAVTRECIYRTRRKREKTQEGDRLARLVDTDTVLDCAC

SEQ ID NO: 771790 - protein, 1960 aa, Homo sapiens [sequence omitted]

SEQ ID NO: 771791 - protein, 1938 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKVRLWR

SEQ ID NO: 771792 - protein, 1949 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKNKTAKGSLSTEQSERG

SEQ ID NO: 771793 - protein, 528 aa, Homo sapiens
MPGEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKPPLPCPLPPLQNKTAKGSLSTEQSERG

SEQ ID NO: 771794 - protein, 1986 aa, Homo sapiens [sequence omitted]

SEQ ID NO: 771795 - protein, 1774 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQNTHLTPFSFCFHFYKGKEDLSDRQPHAT

SEQ ID NO: 771796 - protein, 136 aa, Homo sapiens
VDLEDPKYPPALSQGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDAGPFYEKINLV

SEQ ID NO: 771797 - protein, 1375 aa, Homo sapiens
MNARDTLCSSRARETRLALPRGAHDVPLSSYSNLHVNETTVVVIVSRASFTGLVSENPSRIKAPKRMILQPLKGHLAMVGQRKPVMHHFPSQSLQEEEGAKETRMAITTPTIMEKEMARVATLQRALVLRAELSLANLLEVCAIVTKIVSGQPCHEMSVAFLSILQGKKREISLAMGNERVEMKNSQASCRKCFRVTTTTLTGDILGVLKSIMGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKVRLWR

SEQ ID NO: 771798 - protein, 1938 aa, Homo sapiens; identical to SEQ ID NO: 771791

SEQ ID NO: 771799 - protein, 1986 aa, Homo sapiens [sequence omitted]

SEQ ID NO: 771800 - protein, 104 aa, Homo sapiens
MLPIFCEIFYYKKSICIYPNQFGEIAREMKCSHCQEAGATLGCYNKGCSFRYHYPCAIDADCLLHEENFSVRCPKHKPPLPCPLPPLQNKTAKGSLSTEQSERG

SEQ ID NO: 771801 - protein, 479 aa, Homo sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQGPGAAAWPGSPSLVFILSTSGSPVYLEGQGALSSVLASRPG

SEQ ID NO: 771802 - protein, 635 aa, Homo sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 771803 - protein, 308 aa, Homo sapiens
AGAQGAAEGPHPEMSQVSLSCAGLPGSRWRLGLSEAHGPRPRVISASAGAIPPPHSPRLPASCASAHTHLLATLSSLFTFLSEPKSPSGPRGRGVWSWEHGSGEVRMGLDPSPGLCPPALACRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 771804 - protein, 206 aa, Homo sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAIGQLPEPNRTYFEHAQARNGSPGITHGARGRRFSGDGGPAGEW

SEQ ID NO: 771805 - protein, 348 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMGFRQNQKEGRCSHSLN

SEQ ID NO: 771806 - protein, 316 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMGFRQNQKEGRCSHSLN

SEQ ID NO: 771807 - protein, 348 aa, Homo sapiens; identical to SEQ ID NO: 771805

SEQ ID NO: 771808 - protein, 348 aa, Homo sapiens; identical to SEQ ID NO: 771805

SEQ ID NO: 771809 - protein, 214 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKVLPPFPCGPPIIPPPPPICPDSLDDADALGSMLISWYMSGYHTGYYMGFRQNQKEGRCSHSLN

SEQ ID NO: 771810 - protein, 348 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMVSNHSASFPDNFFVVM

SEQ ID NO: 771811 - protein, 336 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKPGLKFNGPPPPPPPPPPHLLSCWLPPFPSGPPIIPPPPPICPDSLDDADALGSMLISWYMSGYHTGYYMEMLA

SEQ ID NO: 771812 - protein, 304 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMEMLA

SEQ ID NO: 771813 - protein, 274 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKKGNEKNPEVVI

SEQ ID NO: 771814 - protein, 348 aa, Homo sapiens; identical to SEQ ID NO: 771805

SEQ ID NO: 771815 - protein, 316 aa, Homo sapiens
HKCGRAITTRRKREKLLQAVLPATVLFRSQKPRAAEVVTLKKGRGPTLRTRGFAMAMSSGGSGGGVPEQEDSVLFRRGTGQSDDSDIWDDTALIKAYDKAVASFKHALKNGDICETSGKPKTTPKRKPAKKNKSQKKNTAASLQQWKVGDKCSAIWSEDGCIYPATIASIDFKRETCVVVYTGYGNREEQNLSDLLSPICEVANNIEQNAQENENESQVSTDESENSRSPGNKSDNIKPKSAPWNSFLPPPPPMPGPRLGPGKIIPPPPPICPDSLDDADALGSMLISWYMSGYHTGYYMVSNHSASFPDNFFVVM

SEQ ID NO: 771816 - protein, 183 aa, Homo sapiens
GNLRAPQPMGGRRPGQLPFLELQPPPGDCSCHLEPCCASRASNSACARDPFLLQPPRPTAHGAGESRRRAPDPQLPALLPPSRFNTHTPQSLPRPRLGGPTESLRGAQRYRETGLAYGSAQITRVGGARAPIPASMTRSPPLRELPPSYTPPARTAAPQVSRGGAGRRKRAEPGLSLGPLQGL

SEQ ID NO: 771817 - protein, 232 aa, Homo sapiens
MVLVLFVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 771818 - protein, 1338 aa, Homo sapiens
GNLRAPQPMGGRRPGQLPFLELQPPPGDCSCHLEPCCASRASNSACARDPFLLQPPRPTAHGAGESRRRAPDPQLPALLPPSRFNTHTPQSLPRPRLGGPTESLRGAQRYRETGLAYGSAQITRVGGARAPIPASMTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 771819 - protein, 93 aa, Homo sapiens
PWVQDPSWNPQQRANIRPEITFWWTSQPPKANSTKINSTKSKPICQNCSLSDSSACFENQTNKQTSCDFPKGFPRPSPSAISPLIMGFLGLGQ

SEQ ID NO: 771820 - protein, 580 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 771821 - protein, 631 aa, Homo sapiens
IPPAHGGGEIPRHGSGMTGLVSLSYFPLSTRSCALQSCRQPGLGMWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPLLPHRRPRTRLKKKEVYSHDWLRLAGLTPMAGR

SEQ ID NO: 771822 - protein, 69 aa, Homo sapiens
FLWKIEALKCLAPAFADGQHRQRELSKTSAPAPPPSRTELRVQTYPSQAFKTVGHEETMIEPAGNDALN

SEQ ID NO: 771823 - protein, 73 aa, Homo sapiens
GQLVVLGASLPRVRRAGKLAEGVRQRLLPSATRPLSNSSYELKLPRDGDRSGARRQQQQQQQQQQQQPPPPPP

SEQ ID NO: 771824 - protein, 101 aa, Homo sapiens
SAHCNLCLPDSSDSFATASPVAGITGTHHHARLHFVFSVEMGFQPAGQAALEFLTSCDPPASASQSVGITGMSHRARPGINLHQDSLWNFIKRLRSHLLLS

SEQ ID NO: 771825 - protein, 130 aa, Homo sapiens
LSPLGSWYVIKRWYHCPLIALLLVLPLLKWPFLVRSLKLFQHFSTRIPPPPSTKYTCFALLQMLTCQSPEAPEKSAGRHGGLRHSHDLKEIIKMQEGCCEGHTNLVHLSLMKSVRLLVYQMWELLCLFCS

SEQ ID NO: 771826 - protein, 143 aa, Homo sapiens
MGVGPSWLGDVYVIVNEFSRSGHLKVCGISSPTLPLSLSPLYFLCLILSCSYFCHVTYLLSLLPSAMIVSFLRPPQKLMPRCFLYSLQNLSQLNLFSYKLPSLRYFLIAMQEQPNRRSCPKFDNNLKILQTLPIKRVVNLKLF

SEQ ID NO: 771827 - protein, 36 aa, Homo sapiens
METSVKTAMNVNEVYTARAKKIPNKPQSAPGAPGQN

SEQ ID NO: 771828 - protein, 103 aa, Homo sapiens [sequence omitted]

SEQ ID NO: 771829 - protein, 100 aa, Homo sapiens
QALIKTAGCSTLPRVVCWHTLKSLNGYKNLSSGAETREGLRSSSPVDLPLRPRKQATAAGQRKLLSLQLLLCACTSVTDLTYWPSPKAQGHLCQQCESAR

SEQ ID NO: 771830 - protein, 149 aa, Homo sapiens
MPCCSHRRCREDPGTSESQEMEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKP

SEQ ID NO: 771831 - protein, 223 aa, Homo sapiens
IPGRFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCPPYPCVVHSDGQPRFTVSPVPVEKPVSRP

SEQ ID NO: 771832 - protein, 265 aa, Homo sapiens
MIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPGTGLG

SEQ ID NO: 771833 - protein, 99 aa, Homo sapiens
PTEAGGDAVRAGGTAPLSAQQQHECGDADCRESPENPCDCHREPPPETPDINQLPPSILLKVGLGERRRDARFPPPPAPASEAFSLLPLSAEEGGSLAA

SEQ ID NO: 771834 - protein, 177 aa, Homo sapiens
PAEDMRTRLFAVPGRVAKEDWTLDLEPRGPVHIHPTRVSGGLPRCLCWVAVVVPRGMECPGLLQELSTQGQGEPREKRPGLLSFLICSCPPLSSTPLPFPRLSPPWAFVCFGRCHLTRTLIFNPIPLPPTLPHFDLILWLWAEASQGSWVGWVLRPPQTSTETCPCAVCTLHSLPCL

SEQ ID NO: 771835 - protein, 57 aa, Homo sapiens
MPSCPQYRYWLRQRLEAFQRVGSDSLPHLPEYPILQDALSVLSRVVAAHPFLPISPP

SEQ ID NO: 771836 - protein, 332 aa, Homo sapiens
TAVLSECRRLASWERFKTLWIPPAWVGRASWVPPRFPAPAPHEPTLGSMEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 771837 - protein, 198 aa, Homo sapiens
TAVLSECRRLASWERFKTLWIPPAWVGRASWVPPRFPAPAPHEPTLGSMEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPLLDCSSGAAWVPSMCRETEPHVTAHSTRVPKEPGPVIIIHPDSGNNHDNQY

SEQ ID NO: 771838 - protein, 276 aa, Homo sapiens
MIKKMCPSDSELSIPAKNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLPSEMSPDLHRKVSVQYCDVLHKKALRNKKLLRAGSGGGGGDPGDAFGIVAPFARRPSVHSDLMYIREKASAGSQAKDKERCVIS

SEQ ID NO: 771839 - protein, 288 aa, Homo sapiens
AEVTLEDPPQAAMIKKMCPSDSELSIPAKNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLPSEMSPDLHRKVSVQYCDVLHKKALRNKKLLRAGSGGGGGDPGDAFGIVAPFARRPSVHSDLMYIREKASAGSQAKDKERCVIS

SEQ ID NO: 771840 - protein, 276 aa, Homo sapiens; identical to SEQ ID NO: 771838

SEQ ID NO: 771841 - protein, 86 aa, Homo sapiens
AKDAVVGIPSPFRAIQHSFIEYLPTLYQALLVLENRGKNIISPFQEKETFLSLYIQETAQEYKLRHDMGMEGGRSPLGAASHNIKC

SEQ ID NO: 771842 - protein, 73 aa, Homo sapiens
RFKGYPALFVLHKNWHRVKAGPVGLIFHMEVISPLLHEKKGYYRLGIQAVNYLPLKEACRRLYESSSCVRNTH

SEQ ID NO: 771843 - protein, 640 aa, Homo sapiens
ASGASARVCECAPASAPSAAGGQILGAAGPGQAGRSMMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 771844 - protein, 569 aa, Homo sapiens
ASGASARVCECAPASAPSAAGGQILGAAGPGQAGRSMMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRTDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEAARQPNTFQAEGLSLLPGAAEKEGARCWGYRRRLGHRVAQAECRGPRSWAWGRITSSFSFASN

SEQ ID NO: 771845 - protein, 162 aa, Homo sapiens
FIKDSLLQPLTLTLLRSNSAHLRVSSRQLWKELCVSPAMHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQAT

SEQ ID NO: 771846 - protein, 726 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 771847 - protein, 209 aa, Homo sapiens
DSSERISKEMSRIWVLYLKAVSFVNTHCPCHLGPELLTLASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 771848 - protein, 726 aa, Homo sapiens; identical to SEQ ID NO: 771846

SEQ ID NO: 771849 - protein, 647 aa, Homo sapiens
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERAPGWRSCRSRQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 771850 - protein, 122 aa, Homo sapiens
IGCDHPHHLARICCSHSSRRPHPGSPPPGGDPGAGMPGGGGVATTWMGNQILILVPELASGDHHHHLEQALVTIVGAGKGGCGTILGNKKWGQKRVQIRNLEGKLSVSMWYSDENKKTLTIK

SEQ ID NO: 771851 - protein, 69 aa, Homo sapiens
GQKDLVPTHHTMGQKDLVPTTPHHRGSKDLVLTTPHHGPEGPGADTPHHGPEGPGADHTTLIGARRTRY

SEQ ID NO: 771852 - protein, 165 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 771853 - protein, 138 aa, Homo sapiens
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRHVLRKTGGA

SEQ ID NO: 771854 - protein, 197 aa, Homo sapiens
RHEGMCVDALLREEPREVGPHLYEHSLCLKERESPCVAPQKESCPTTCLSHPARSGHRPTEMLPTPCHMSTEGTGTFFSQFPRANAERRPRFALRRPHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 771855 - protein, 879 aa, Homo sapiens
MNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVDERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLPVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 771856 - protein, 957 aa, Homo sapiens
MQPMVMQGCPYTLPRCHDWQAADQFHHSSSLRSTCPHPQVRAAVTSPAPPQDGAGVPCLSLKLLNGSVGASGPLEPPAMNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVDERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLPVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 771857 - protein, 591 aa, Homo sapiens
KPERRESPARPTAMRQQDAPKPTPAARRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 771858 - protein, 592 aa, Homo sapiens
RLMRPGLMPLPFPSRSQQDAPKPTPAARRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 771859 - protein, 461 aa, Homo sapiens
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHGPLAGYLYPAFPGRAIKSEYPEPYASPPQPGLPYGYPEPFSGGPNVPELILQLLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 771860 - protein, 245 aa, Homo sapiens
VEEEGDVSNRGVELLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 771861 - protein, 461 aa, Homo sapiens; identical to SEQ ID NO: 771859

SEQ ID NO: 771862 - protein, 407 aa, Homo sapiens
CEGTSCCYIQQSELSISQKKSMFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 771863 - protein, 58 aa, Homo sapiens
RVEVCAYVRSRIYHVPAHISFFKRALQVLRIGTGCVACVCTNSLVTKFLATCVLSHPP

SEQ ID NO: 771864 - protein, 114 aa, Homo sapiens
IPHTHSQPQTHSYLPPHSRRDGWMPWPSAHGMALCPHFGFCAQWDTRACSHSYTHTHTTLPHGACVCMTLHTQPHRDSHRHTQACLETDVTHTGVHRHTWADTLTDTNTALAGG

SEQ ID NO: 771865 - protein, 241 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPSLLYADLDHLALSRPRRLSTADPADASTIYAVVV

SEQ ID NO: 771866 - protein, 81 aa, Homo sapiens
LTQLSVQLPGGVRTASHLAELAGNRRQEQELGCSGPHGGLDGESGSVGSGAFPLHAIAIPVMGGTEIPVVPVTAPASTCRA

SEQ ID NO: 771867 - protein, 127 aa, Homo sapiens
DHKCMPPCLANFKNIYFVETGSSYIAQTGLKLLGSSSPPAFASQSARIPGMSYHAWLLLIFFKALHKYSQRSHHIVEKQKYIQLNVLCWMYTFEEEHRKKVWKRNVDRAFMLKQQMKIEPRSLKASV

SEQ ID NO: 771868 - protein, 54 aa, Homo sapiens
MTPSLQPSSSEGPLPTSTSWAFLGGPETYGNLDVCPPGPEPGLRYSPTYLSTAA

SEQ ID NO: 771869 - protein, 408 aa, Homo sapiens
MSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 771870 - protein, 408 aa, Homo sapiens; identical to SEQ ID NO: 771869

SEQ ID NO: 771871 - protein, 432 aa, Homo sapiens
MSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDTWQVRNGEEEEGRSSEGGREAEKDDSTSHSDHQDPISLAVEMAAVNHTILALARQGANEIKTEALDDD

SEQ ID NO: 771872 - protein, 394 aa, Homo sapiens
MSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDTWQVRNGEEEEGRSSEGGREAEKVEEERRI

SEQ ID NO: 771873 - protein, 432 aa, Homo sapiens; identical to SEQ ID NO: 771871

SEQ ID NO: 771874 - protein, 408 aa, Homo sapiens; identical to SEQ ID NO: 771869

SEQ ID NO: 771875 - protein, 79 aa, Homo sapiens
EHGHRKASAGPSLRSLSHHSTGVFRHTLAARQDTPPAERHHVRHHCLPWKSPQPSMISPPGSPCLPRPWSRWVCSTFQG

SEQ ID NO: 771876 - protein, 79 aa, Homo sapiens; identical to SEQ ID NO: 771875

SEQ ID NO: 771877 - protein, 432 aa, Homo sapiens; identical to SEQ ID NO: 771871

SEQ ID NO: 771878 - protein, 79 aa, Homo sapiens; identical to SEQ ID NO: 771875

SEQ ID NO: 771879 - protein, 375 aa, Homo sapiens
MSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQTDRMQAEVVAQE

SEQ ID NO: 771880 - protein, 66 aa, Homo sapiens
STCERYNNKHNYSSLPDEAYGQVERIQTLGWVQWLTPVIPALWEAEVGGSQGQEIKTILANMAQSH

SEQ ID NO: 771881 - protein, 130 aa, Homo sapiens
MDDFAKPRPQTAQRGERVAARTQGGLGARRRGSGSQPEGDLSSPESGPVTRHIFAGTEAGEPAAPEGRAARSDGQRPPPLAPPPTGRSNLGAPESQLSGPGTRLDSPPRPTRAGSVPRPSRNFPPVRPRA

SEQ ID NO: 771882 - protein, 89 aa, Homo sapiens
GESSQQAGHLCTSMTDHPMVPQIYLPKTLFFLPGTHSSGTAKPPFQLSDQLQQQDPPGPASSSAPTLGLLPAIATTIAVCFLLHSLGPS

SEQ ID NO: 771883 - protein, 427 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 771884 - protein, 427 aa, Homo sapiens; identical to SEQ ID NO: 771883

SEQ ID NO: 771885 - protein, 70 aa, Homo sapiens
GAVCAGSAEQLVHPPAGPEAFGSEVSVRPHRRAPLGSTYLPPAPSGMEAMAASTSLPPQCGCKAAVHPQG

SEQ ID NO: 771886 - protein, 119 aa, Homo sapiens
GAVCAGSAEQLVHPPAGPGLLNLAQLDGEMDSASSDSLMPGPVHIALLASLNPHSFSLEAFGSEVSVRPHRRAPLGSTYLPPAPSGMEAMAASTSLPDPGDFDRNVPRICGVCGDRDVG

SEQ ID NO: 771887 - protein, 88 aa, Homo sapiens
SEEASVIHLEERLSVPVPHTYSSLSQRPHLGVNGQTLPTSWAGLAAESMHLKLYHSAPASQVHLYYSLIYRVAGTTDLEIFMGGELTL

SEQ ID NO: 771888 - protein, 473 aa, Homo sapiens
GAVCAGSAEQLVHPPAGPEAFGSEVSVRPHRRAPLGSTYLPPAPSGMEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 771889 - protein, 346 aa, Homo sapiens
RVSATLAMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 771890 - protein, 427 aa, Homo sapiens; identical to SEQ ID NO: 771883

SEQ ID NO: 771891 - protein, 191 aa, Homo sapiens
GAVCAGSAEQLVHPPAGPGLLNLAQLEEKWTLASSDSLMPGPVHIALLASLILIASLWEAFGSEVSVRPHRRAPLGSTYLPPAPSGMEAMAASTSLPDPGDFDRNVPRICGVCGDRATGFHFNAMTCEGCKGFFRRSMKRKALFTCPFNGDCRITKAHSTRSGPFNSAPGHPTAPAQSTLPAVHAAAKCIA

SEQ ID NO: 771892 - protein, 111 aa, Homo sapiens
WYSLALFPRLECSGLISAYCNLCLLSSSNSPASASQVAGITGAHHHSQLIFVFLVETGFRDVGQAGFELLTSGDPPASASQSSGITDVSHHTWPRNAFSSIPIQNYSVGPE

SEQ ID NO: 771893 - protein, 67 aa, Homo sapiens
PLVHGPLALPQSRPIELWLTFPGPHMANLRGPFLSSCALPCLPLVFALPDVPPAPIWASAFLVFSVF

SEQ ID NO: 771894 - protein, 103 aa, Homo sapiens
MVNLVPNWSSIYWFLIFFFFLRRSLALSSRLERNGSISAHCNFRFLGSSDSPASASQVAGITVAHRHARLIFVFLWRPGFTMLARLVFELDLRSLVLFLTRGF

SEQ ID NO: 771895 - protein, 72 aa, Homo sapiens
VGRPLPCPESNVFSMGQHGPWMGLSIADHVVTCACVDMCACVDMYAPECICMSFLHTQCSPPMLPACGDFLF

SEQ ID NO: 771896 - protein, 85 aa, Homo sapiens
ASTKQGGGSTHQAEKSLPPLLQPNSVAPYGSPWTNGCGLGGGVLWPGLDHLSILSGSGGSPQRQTQERGSARMSPRCPVLPRGQL

SEQ ID NO: 771897 - protein, 258 aa, Homo sapiens
GRFHPQRMIISRHLPSVSSLPFHPQLHPQQMIISRHLPSVCGGRFHPQRMIISRHLPSVSSLPFHPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 771898 - protein, 271 aa, Homo sapiens
GPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPS

SEQ ID NO: 771899 - protein, 448 aa, Homo sapiens
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 771900 - protein, 448 aa, Homo sapiens; identical to SEQ ID NO: 771899

SEQ ID NO: 771901 - protein, 463 aa, Homo sapiens
MLFRYAEKITRKYSEMDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 771902 - protein, 112 aa, Homo sapiens
LLLLRRGLRQHLRPQETPPGAQGREPRGAWSRGGHLGREGCLTEGFPSHSHQKPPSGLPPPRTDQTLPPSSLLPHPSELHTDWRPSGRTPDRLKTESLPSSTSLPSPHPIRH

SEQ ID NO: 771903 - protein, 223 aa, Homo sapiens
GQVSRKCHQWGGATTSLPFCEVLLSLLQQGQDETMTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 771904 - protein, 205 aa, Homo sapiens
GQVSRKCHQWGGATTSLPFCEVLLSLLQQGQDETMTDKTEKVAVDPETVFKRPRECDSPSYQIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 771905 - protein, 70 aa, Homo sapiens
PGLQKQTSKPADQQVDSQTMRQRKKEEEEHLNTERSSAGGGWRGVQPLGSPTPGEDHHPIPSPASGFPSI

SEQ ID NO: 771906 - protein, 118 aa, Homo sapiens
YTGLRKHVCDMHRLLCYAQALGNTHVTCTGCPAHACLCPAPWASWYLPAALVPQPPCLSSPRPLGFWGKFSTCRTNSETTCVLALPICHHLQCPQTQQTVPTMPSCPFSLTHQLSFNT

SEQ ID NO: 771907 - protein, 332 aa, Homo sapiens
MKAFVQISGKDGTVVFSLGPVVQNLIEEKADLIASDLAQIATEGRPTTLSETMRKADVWLIRNSWNFQFPHPLLPNVDFVGGLHCKPAKPLPKEMEEFVQSSGENGVVVFSLGSMVSNMTEERANVIASALAQIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 771908 - protein, 345 aa, Homo sapiens
CTRMALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGELLAELFNIPFVYSHSFSPGYSFERHSGGFIFPPSYVPVVMSKLSDQMTFMERVKNMLYVLYFDFWFQIFNMKKWDQFYSEVLGRPTTLSETMRKADVWLIRNSWNFQFPHPLLPNVDFVGGLHCKPAKPLPKEMEEFVQSSGENGVVVFSLGSMVSNMTEERANVIASALAQIPQKSAVQVDTPE

SEQ ID NO: 771909 - protein, 129 aa, Homo sapiens
MRKADVWLIRNSWNFQFPHPLLPNVDFVGGLHCKPAKPLPKEMEEFVQSSGENGVVVFSLGSMVSNMTEERANVIASALAQIPQKVLWRFDGNKPDALGLNTRLYKWIPQNDLLGNLPWDPYGGHSIVF

SEQ ID NO: 771910 - protein, 106 aa, Homo sapiens
LTFSVGIFIFILQIYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 771911 - protein, 531 aa, Homo sapiens
CTRMALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGELLAELFNIPFVYSHSFSPGYSFERHSGGFIFPPSYVPVVMSKLSDQMTFMERVKNMLYVLYFDFWFQIFNMKKWDQFYSEVLGRPTTLSETMRKADVWLIRNSWNFQFPHPLLPNVDFVGGLHCKPAKPLPKEMEEFVQSSGENGVVVFSLGSMVSNMTEERANVIASALAQIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 771912 - protein, 332 aa, Homo sapiens; identical to SEQ ID NO: 771907

SEQ ID NO: 771913 - protein, 172 aa, Homo sapiens
MKAFVQISGKDGTVVFSLGPVVQNLIEEKADLIASDLAQIATEGRPTTLSETMRKADVWLIRNSWNFQFPHPLLPNVDFVGGLHCKPAKPLPKEMEEFVQSSGENGVVVFSLGSMVSNMTEERANVIASALAQIPQKVLWRFDGNKPDALGLNTRLYKWIPQNDLLDIKRIL

SEQ ID NO: 771914 - protein, 112 aa, Homo sapiens
PHLPYTDMLVRSRVVFLSSTYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 771915 - protein, 120 aa, Homo sapiens
MSYMAGAGGRERSGRCYTLLFIFIYYFETKSGSTTRLECSGAILVHCNLCLLGSSHPPTSASRVVGTTGMHHNAQLIFEFFVETGFCHVSRAGLKLLCASNPHTLASQSTEITGVSLCAW

SEQ ID NO: 771916 - protein, 550 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 771917 - protein, 563 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 771918 - protein, 519 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRWAPTQKEAGIYPRKGKQTRQQQEHQKYMVPLQASAQEKNGL

SEQ ID NO: 771919 - protein, 506 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRKGKQTRQQQEHQKYMVPLQASAQEKNGL

SEQ ID NO: 771920 - protein, 433 aa, Homo sapiens
AGLRVSRWELGIASRRWFEDLQHQPHTSEVLKRPQPRHHPGLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 771921 - protein, 196 aa, Homo sapiens
RIFPSRAASASRSQREPPPPSLPLPSPPPAAPAMSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIEFTSALKSPRSLPCLEKGLSPNPQPFLHLSAISFSPPSPGSVCVCVRVCVPL

SEQ ID NO: 771922 - protein, 57 aa, Homo sapiens
MSATAATAPPAAPAGEGGPPAPPPNLTSNRRLQQTQAQVDEVLKSASPWPIKASAPS

SEQ ID NO: 771923 - protein, 165 aa, Homo sapiens
MDRSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIEFTSALKSPRSLPCLEKGLSPNPQPFLHLSAISFSPPSPGSVCVCVRVCVPL

SEQ ID NO: 771924 - protein, 162 aa, Homo sapiens
GPQASSETSTSGDGLGPISPTPLHPEQSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVSRVRMAGALSLERFPQWILGFEGH

SEQ ID NO: 771925 - protein, 196 aa, Homo sapiens; identical to SEQ ID NO: 771921

SEQ ID NO: 771926 - protein, 169 aa, Homo sapiens
RIFPSRAASASRSQREPPPPSLPLPSPPPAAPAMSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVSRVRMAGALSLERFPQWILGFEGH

SEQ ID NO: 771927 - protein, 153 aa, Homo sapiens
MDRSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIASAVPPPLSHIFQPPLPWIRVCVCPCVCPPVNSQLLFIHI

SEQ ID NO: 771928 - protein, 196 aa, Homo sapiens; identical to SEQ ID NO: 771921

SEQ ID NO: 771929 - protein, 196 aa, Homo sapiens; identical to SEQ ID NO: 771921

SEQ ID NO: 771930 - protein, 196 aa, Homo sapiens; identical to SEQ ID NO: 771921

SEQ ID NO: 771931 - protein, 196 aa, Homo sapiens; identical to SEQ ID NO: 771921

SEQ ID NO: 771932 - protein, 138 aa, Homo sapiens
MDRSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVSRVRMAGALSLERFPQWILGFEGH

SEQ ID NO: 771933 - protein, 83 aa, Homo sapiens
DSYENGYSADPFQVDEVVDIMRVNVDKVLERDQKLSELDDRADALQAGASQFETSAAKLKRKYWWKNLKSLLQHLNPRGVCPA

SEQ ID NO: 771934 - protein, 196 aa, Homo sapiens; identical to SEQ ID NO: 771921

SEQ ID NO: 771935 - protein, 196 aa, Homo sapiens; identical to SEQ ID NO: 771921

SEQ ID NO: 771936 - protein, 110 aa, Homo sapiens
MDRSATAATAPPAAPAGEGGPPAPPPNLTSNRRLQQTQAQVDEVVDIMRVNVDKVLERDQKLSELDDRADALQAGASQFETSAAKLKRKYWWKNLKSLLQHLNPRGVCPA

SEQ ID NO: 771937 - protein, 133 aa, Homo sapiens
KVTQLIGGRAGPRPGLTSGGLPPEKEDWRDEDGQVDGRSPGCGAGRLQALGLNPSLLLRSATAATAPPAAPAGEGGPPAPPPNLTSNRRLQQTQAQVDEVSVGGVKSSRRDPGGWRIGVGAHVGLGVMTVHAC

SEQ ID NO: 771938 - protein, 191 aa, Homo sapiens
MMRMKTFVMIHFHLMNGGKAKLYSRPHAKLLPEQRVTDKTGAPVEWPGQTQCSTADSDPGSHACAGSDESDMYFVDMHKSRVCTGTDMKLRLPASPETHLDMLRHLYQGQQVVQGNLELTYLPTNASLSFLQDIQEVQGYVLIAHNQVRQVPLQRLRIVRGTQLFEDNYALSVLHNGDPLNHTTPVTGAST

SEQ ID NO: 771939 - protein, 135 aa, Homo sapiens
PPPCHCFWIPVSKGVLSSALEHLRLFECWKRIRSGYITSQLEGQILAMLSSDDRLVTTDQTKTVFVCWQWPPQGDLANMQILTSLISDLSGWDKFFWPVSSCHTQSWSLLALSCSFAFGHRVLVRGTPLSPTLPP

SEQ ID NO: 771940 - protein, 394 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 771941 - protein, 209 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGVCGIFLLYHATCAGK

SEQ ID NO: 771942 - protein, 371 aa, Homo sapiens
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRADFFLLTGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 771943 - protein, 394 aa, Homo sapiens; identical to SEQ ID NO: 771940

SEQ ID NO: 771944 - protein, 303 aa, Homo sapiens
MGRKVHSNGSQFAEHSRSPRRTGRDCKPVRAPSMALGVSQLAGRSRCLCSESQGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 771945 - protein, 33 aa, Homo sapiens
MVTMEELREMDCSVLKRLIIAGHEMVPSSIHCL

SEQ ID NO: 771946 - protein, 303 aa, Homo sapiens; identical to SEQ ID NO: 771944

SEQ ID NO: 771947 - protein, 205 aa, Homo sapiens
ELGHALRGSGTPARQARPRLLPLPARGSGGGAGLGTPASAAGRRPPSSRGFPGGSAPTVDSRPARRGRSRGSADLGALSPWPLGDPPRPRGENLGTAPRPRPSLRRSFSPATVDSSSRAWVGGSCGGRGRTTWRGRAGGGRRDPRPRGEPLGGAGRSREDPQWGAGRNLAPAPTRRAHACRGRLFPAGARPRSGGGARAAGAAWV

SEQ ID NO: 771948 - protein, 69 aa, Homo sapiens
MDPSIWKGPRKEHWVWRSGEDLKSQQKVRGEVDQQQKVDAEQKVDAEQKVDAEQKVDAEQKVDAEHKVD

SEQ ID NO: 771949 - protein, 99 aa, Homo sapiens
RHTGQSMARLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 771950 - protein, 99 aa, Homo sapiens; identical to SEQ ID NO: 771949

SEQ ID NO: 771951 - protein, 333 aa, Homo sapiens
PEQKRARKKMPRPGRNTYSDQKPPYSYISLTAMAIQSSPEKMLPLSEIYKFIMDRFPYYRENTQRWQNSLRHNLSFNDCFIKIPRRPDQPGKGSFWALHPSCGDMFENGSFLRRCKRFKVLKSDHLAPSKPADAQYLQQQAKLRLSALAASGTHLPQMPAAAYNLGGVAQPSGFKHPFAIENIIAREYKMPGGLAFSAMQPVPAAYPLPNQLTTMGSSLGTGWPHVYGSAGMIDSATPISMASGDYSAYGVPLKPLCHAAGQTLPAIPVPIKPTPAAVPALPALPAPIPTLLSNSPPSLSPTSSQTATSQSSPATPSETLTSPASALHSVAVH

SEQ ID NO: 771952 - protein, 1137 aa, Homo sapiens
MVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 771953 - protein, 126 aa, Homo sapiens
SLASSESSNPNGAWHRYSLHFSSSSHNTLRPAPRGSAQESAVRPRRMVEPLEDRRQENFFCGPPGKLQPGQFLVLIVVPTPPSRTGRPRTNLGRQKGKVASWPQSSQGSRVTAGIGEFSDAPARQG

SEQ ID NO: 771954 - protein, 1188 aa, Homo sapiens
LVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 771955 - protein, 1059 aa, Homo sapiens
MVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 771956 - protein, 1690 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771957 - protein, 143 aa, Homo sapiens
EGLVSCLKVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLR

SEQ ID NO: 771958 - protein, 137 aa, Homo sapiens
GFPGHSRDGHGTPGWITSYGRGLHGSLGPRVDQGPGEAHLHSRGETASQMGGPLGWVGGAATHQVGWNVHVPHAGMQRRRRRVLDTSVAYVRGEENLAGWRPRSDSLILDHQWELEKLSLLQEVRQPQRMRPARWCP

SEQ ID NO: 771959 - protein, 1699 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKLTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771960 - protein, 1359 aa, Homo sapiens
MVSVSCLLWAPSLTFSHLHLFSLPPSVCLPALPLLPIDVSDLENNNLNRGGTVNEAPDPLSTVTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771961 - protein, 1690 aa, Homo sapiens; identical to SEQ ID NO: 771956

SEQ ID NO: 771962 - protein, 1668 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771963 - protein, 1690 aa, Homo sapiens; identical to SEQ ID NO: 771956

SEQ ID NO: 771964 - protein, 1690 aa, Homo sapiens; identical to SEQ ID NO: 771956

SEQ ID NO: 771965 - protein, 1690 aa, Homo sapiens; identical to SEQ ID NO: 771956

SEQ ID NO: 771966 - protein, 1690 aa, Homo sapiens; identical to SEQ ID NO: 771956

SEQ ID NO: 771967 - protein, 127 aa, Homo sapiens
VSYIQEIQVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771968 - protein, 1690 aa, Homo sapiens; identical to SEQ ID NO: 771956

SEQ ID NO: 771969 - protein, 1522 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLR

SEQ ID NO: 771970 - protein, 1348 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGRYLPCSHWV

SEQ ID NO: 771971 - protein, 1071 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEYQSFIEQSVLNRY

SEQ ID NO: 771972 - protein, 191 aa, Homo sapiens
PPWLTVPPFLQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKATVNPQATVNPQATVNPRATVNHKPRST

SEQ ID NO: 771973 - protein, 1690 aa, Homo sapiens; identical to SEQ ID NO: 771956

SEQ ID NO: 771974 - protein, 1071 aa, Homo sapiens
ISSVLTVHVHKGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771975 - protein, 1059 aa, Homo sapiens
QALDGRACPSRGAGTSCVARVHRRTPYLRHARWVLYDSLLGAEWKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771976 - protein, 730 aa, Homo sapiens
KKHLDTAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 771977 - protein, 1690 aa, Homo sapiens; identical to SEQ ID NO: 771956

SEQ ID NO: 771978 - protein, 100 aa, Homo sapiens
TRRFRQLSPGGSGVGITCQCADSGTACCLRTIRVGWWVETRKSGKIGIQGDGLGVEGCGAASSAAARNGVSQGSFWEEMLPLAGFLQRLSSLCSQGREFL

SEQ ID NO: 771979 - protein, 1690 aa, Homo sapiens; identical to SEQ ID NO: 771956

SEQ ID NO: 771980 - protein, 109 aa, Homo sapiens
QEPRAEHSGVRHRDGRRDVGTAAMTWRVWGLVLVWGQPSSTRKGELLPLRLQIDGDAGLQADQHLGSDGTRPVPRGAKSKASHWESSLRRCQCFIHRLHRHKLPHPGRL

SEQ ID NO: 771981 - protein, 110 aa, Homo sapiens
SVSCLLWAPSLTFSHLHLFSLPPSVCLPALPLLPIDVSDLENNNLNRGGTVNEAPDPLSTVTNALVGMSPSSSLSALSSRAASVSSLHERILFAPGSEEAIERLKVRAPP

SEQ ID NO: 771982 - protein, 97 aa, Homo sapiens
EHVVASWNWLLPRVLKKVGSVTQRGARGVCQEQTSSATLDPLTHTGQAPLGSNRTDQLFGVGQYHGVLHALQGAGVPSRLSAGCCVCAVHITAGGSP

SEQ ID NO: 771983 - protein, 350 aa, Homo sapiens [sequence omitted]

SEQ ID NO: 771984 - protein, 86 aa, Homo sapiens
METSATRAGSQVVATTARHSAAYRADPLRVSSRDKLTEMAASSQGNIEGNFESLDLTEFAKKQPWWRKLFGQESGPSAEKYSMATQ

SEQ ID NO: 771985 - protein, 916 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 771986 - protein, 514 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMAVAQKAARKKLSMKNLM

SEQ ID NO: 771987 - protein, 767 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKPTIFNSPCYLVQHK

SEQ ID NO: 771988 - protein, 290 aa, Homo sapiens
MVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAGREKSRHKKATIFNSPCYLVQHK

SEQ ID NO: 771989 - protein, 611 aa, Homo sapiens
MRYFYFSTETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIRSTVEDMSHLEDRNSCVITIISKVPESTTQEHSINVFQEMHEEKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAGREKSRHKKATIFNSPCYLVQHK

SEQ ID NO: 771990 - protein, 113 aa, Homo sapiens
EISSSPESCPEEIKHEEFDVNLSSDAAFGILKEPLTIIHPLLGCSDPYALTRVLHEVEPRYVVLYDAELTFVRQLEIYRASRPGKPLRQVIKNHSFQLHSSLGFNPETIPVAC

SEQ ID NO: 771991 - protein, 638 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIRSTV

SEQ ID NO: 771992 - protein, 636 aa, Homo sapiens
MFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIRSTVEDMSHLEDRNSCVITIISKVPESTTQEHSINVFQEMHEEKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAGREKSRHKKATIFNSPCYLVQHK

SEQ ID NO: 771993 - protein, 312 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLES

SEQ ID NO: 771994 - protein, 297 aa, Homo sapiens
MHEEKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAGREKSRHKKATIFNSPCYLVQHK

SEQ ID NO: 771995 - protein, 110 aa, Homo sapiens
QASKGPEQGQGIYAGPLSTSKAQNGISKSRWEGGWLGAVQVRGCRDGGKHYQGGRLIHLPPKTQHRASHSAGHANIHEVASTSTSKPLTPGSCSGTPAPGGYTDSQAGNP

SEQ ID NO: 771996 - protein, 349 aa, Homo sapiens
SSLGLPSVSLGVSLCVRSALLEAVVPMLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRR

SEQ ID NO: 771997 - protein, 349 aa, Homo sapiens; identical to SEQ ID NO: 771996

SEQ ID NO: 771998 - protein, 385 aa, Homo sapiens
SSLGLPSVSLGVSLCVRSALLEAVVPMLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEAFLPHQVDDTATPSGMTHGLAGACPLDAIRLPASEQVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRR

SEQ ID NO: 771999 - protein, 228 aa, Homo sapiens
RLVRSEVLYAKSDVPPAGPGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQVHCWGLGTANSTHSPLPDPQSEMAPDPSSLKPIGPESGSPHTVPGPQEHTPPRRWALPHPQSSCREAAVARLLGHGSPASVAEDIFPSGFRGRHLQTPGP

SEQ ID NO: 772000 - protein, 230 aa, Homo sapiens
PLPPALSTPPDGLSHARLSPQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQVHCWGLGTANSTHSPLPDPQSEMAPDPSSLKPIGPESGSPHTVPGPQEHTPPRRWALPHPQSSCREAAVARLLGHGSPASVAEDIFPSGFRGRHLQTPGP

SEQ ID NO: 772001 - protein, 349 aa, Homo sapiens; identical to SEQ ID NO: 771996

SEQ ID NO: 772002 - protein, 520 aa, Homo sapiens
SSLGLPSVSLGVSLCVRSALLEAVVPMLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 772003 - protein, 349 aa, Homo sapiens; identical to SEQ ID NO: 771996

SEQ ID NO: 772004 - protein, 349 aa, Homo sapiens; identical to SEQ ID NO: 771996

SEQ ID NO: 772005 - protein, 115 aa, Homo sapiens
HHVLVSASHLPSLLNPLLFVPCCCHSPETPLAKVPRVFTLTSQSSSSHCSTPQVFPNIVQGISIHLVAETKYLHSSYPTPDCAQFLLCPPSLVGCSLLILSCHLSLLTCITLVAS

SEQ ID NO: 772006 - protein, 109 aa, Homo sapiens
MVFLCVQHAPLCLHGVSLCIAPASRLFARCFFGHSTCLSVVCTVFLCAQHPPLCLHGVSLCIAPASRLFAQCFFGHSTSLSVVCMAFLCAQHPPLSLHGVSLCVAPDSW

SEQ ID NO: 772007 - protein, 635 aa, Homo sapiens
EFRHTSALTQHTAHTQHTSAHTQHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 772008 - protein, 43 aa, Homo sapiens
GPPRAGKGTQAPRLAENFCVCHLATGDMLRAMVASGSELGKKL

SEQ ID NO: 772009 - protein, 74 aa, Homo sapiens
AEKLLSTSPWVGADRNFLWGKRALLPAAGSLNTRLAVTGNWADRAPTLWVPRSASCSSGPAALPVGLGSLLCLS

SEQ ID NO: 772010 - protein, 364 aa, Homo sapiens
MLISKKAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQK

SEQ ID NO: 772011 - protein, 228 aa, Homo sapiens
MLISKKAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSAP

SEQ ID NO: 772012 - protein, 407 aa, Homo sapiens
MLISKKAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLVSERWTLLTWTTDPIFNSGMLNSFFASWSVPMRARCLIPFSLQDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQK

SEQ ID NO: 772013 - protein, 454 aa, Homo sapiens
MPTHMDPHYTTVRAPTLTNSGETKRTLKIRLLFDYESDNNDDTKHQQQQTNTHLIQWMILSKLSTAPIRAEKQNAETPQRGSKRATRDHTEQTRHEENTQYYHHPSTDEQKKTHNAKKTTATDTHHTHTATKLPPTNETTKTKHERHLPTLARTIHLGLYRERERRRAQERKRRRKKGRASRGRHHPKETAEGPNIATQIPRANNTKQKEKKTKQTTHSPDPQEEEEVEPPPHRRLRMISRSSEIRKKQINEYDLTSSITHPSSSRGDKNKKQHNDPDTNRHVRTQRTHATSRHSKVITEIQHKEHYTAQRRKAQDERKRREEMRERRKERRPDDAHRTHAITNRNDEGQQGTDTQSEHATSTTRSHATRTTSHAPSRRERDGTKPVTQPLDHPSRRQPRTRDDPTHRSAQQRPSTTGPTEQRVAHHRRATQQLHTATPVTRVASTQTRHVTTP

SEQ ID NO: 772014 - protein, 122 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGK

SEQ ID NO: 772015 - protein, 203 aa, Homo sapiens
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLACRLISEARQNTLVNNVSSPLPGEGKSISYLTCCNFN

SEQ ID NO: 772016 - protein, 203 aa, Homo sapiens; identical to SEQ ID NO: 772015

SEQ ID NO: 772017 - protein, 203 aa, Homo sapiens; identical to SEQ ID NO: 772015

SEQ ID NO: 772018 - protein, 165 aa, Homo sapiens
THASADAWVMIKTVEINGEKELQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLACRLISEARQNTLVNNVSSPLPGEGKSISYLTCCNFN

SEQ ID NO: 772019 - protein, 655 aa, Homo sapiens
PASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 772020 - protein, 238 aa, Homo sapiens
SPLAAAAAAAAPAPATLRPPPPPGAPAARPDMSEAVRVPSPATPLVVAAAAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTVSIMTCK

SEQ ID NO: 772021 - protein, 134 aa, Homo sapiens
MDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILFTESSV

SEQ ID NO: 772022 - protein, 272 aa, Homo sapiens
SPLAAAAAAAAPAPATLRPPPPPGAPAARPDMSEAVRVPSPATPLVVAAAAPEERKGKESEREKLPPIVSAGAGATAGLDRGAKGQISTFSSFISAVSPKKEAAENRSSPAHLVFPNIKNVREPPPICLDVRQKQRTSMDASSSEMKAPVLPEPILPIQPKTVKDFQEDVEKVKSSGDWKAVHDFYLTTFDSFPELNAAFKKDATASFNTIEDSGINAKFVNAVYDTLLNTPQDVQKTVLKGIINSLLREWKGPRTKDDLRAYFILFTESSV

SEQ ID NO: 772023 - protein, 284 aa, Homo sapiens
LGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRQMEHREMCLGILKKNEWRTLDTVPIRST

SEQ ID NO: 772024 - protein, 487 aa, Homo sapiens
LGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 772025 - protein, 74 aa, Homo sapiens
MVPTCNSNSPRVQAFPGASPPRRISTISKGTKGNYTSGVGEYSSSIQNSDNDLAVVQGSSSFSRKGYPSLKGAQ

SEQ ID NO: 772026 - protein, 139 aa, Homo sapiens
RSYHSEQLTGSRSHSPGGATLGCLGVCAVLLSPRACVQSCCPQGQVGEVMGEAERAMEGCGVPRSREAHRRTGFLQRWAGSLTFLLSNFSEVCVCVCVCVCVCEVGGVLLPPGILSLWGNGGRSIEPQGLGLPSSPRPL

SEQ ID NO: 772027 - protein, 91 aa, Homo sapiens
GTGRQEVERSASYLTASHVSVNPGKAVHPDSSNWLQLPRKSHFDPRVGTGSSTYRWSPLFRDLNSCSLSLCSEPLRSRHQPGMSLILASSF

SEQ ID NO: 772028 - protein, 132 aa, Homo sapiens
GSCYVAQTGVQWLFAGMIPLLISAGVLTCLFPIWASSPLISKSGGPPSWEVTILMLNLVWTPNWHSTVQPRTLGLKPSSCRSFPSSWDYRHAPPYLATFFINTFPFAACSLLFHFHFFNSLLKPRTVINPFQ

SEQ ID NO: 772029 - protein, 74 aa, Homo sapiens
RNVLGLRKRHLDEERHWDENVIWDEERHFQPRNHCTAPIRHDLIWQFQLKRQQETKKLVEKVISHFLSCPITKD

SEQ ID NO: 772030 - protein, 47 aa, Homo sapiens
YTHGGCISPKTDKSKAVNKHPHLNSIKPKSMLNEVKSVHSIANVNTF

SEQ ID NO: 772031 - protein, 128 aa, Homo sapiens
CAGNERGSVGVGPSEPCAGYNILVCCLLRPLEKCSIRVGVTQFSRCHLSPLPLAMKENSLTPCTSQVRRCLALLRLMVSALHPLSCTHCPTIPSEMNLVPQLEVQKSPAFCVAHAGSYRLELFLFSHL

SEQ ID NO: 772032 - protein, 213 aa, Homo sapiens
WRSTFAPPGRRRMRDSPLARPAAPAGASPFTFKSPRELGNSAQGQGPSLAVTAGSALRVWLWYSLAYPASGLLTALQACPARRNPPPDAEEKKVVSEALEMLRLLRGSPKPNRHPRSGPVPAHGVASAAAGPATMREPPGRGASFETMWPTENLSSRRRAPPQRRRTRAPSIARSLPGSGRLLGLIFPSTGKNVQRHKSPPLPSEESLSQRSR

SEQ ID NO: 772033 - protein, 112 aa, Homo sapiens
GNGMRPEGLGKARGGVAQEVSRMEEEASSKEQEEWTLVRGNHVPPTKCALHKDPARPSVPAGSLSWHQPCPQRERPGDRWRCTCGSLGKSILQPRAPSRLPASRSSFTPWSS

SEQ ID NO: 772034 - protein, 911 aa, Homo sapiens
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 772035 - protein, 514 aa, Homo sapiens
TPLTDRCYITLAQALGMSMGGAPAGPAGTGKTETTKDMGRCLGKYVVVFNCSDQMDFRGLGRIFKGLAQSGAWGCFDEFNRIDLPVLSVAAQQISIILTCKKEHKKSFIFTDGDNVTMNPEFGLFLTMNPGYAGRQELPENLKINFRSVAMMVPDRQIIIRVKLASCGFIDNVVLARKFFTLYKLCEEQLSKQVHYDFGLRNILSVLRTLGAAKRANPMDTESTIVMRVLRDMNLSKLIDEDEPLFLSLIEDLFPNILLDKAGYPELEAAISRQVEEAGLINHPPWKLKVIQLFETQRVRHGMMTLGPSGAGKTTCIHTLMRAMTDCGKPHREMRMNPKAITAPQMFGRLDVATNDWTDGIFSTLWRKTLRAKKGEHIWIILDGPVDAIWIENLNSVLDDNKTLTLANGDRIPMAPNCKIIFEPHNIDNASPATVSRNGMVFMSSSILDWSPILEGFLKKRSPQEAEILRQLYTESFPDLYRFCIQNLEYKMEVLEAFVITQSINMLQGLIPLK

SEQ ID NO: 772036 - protein, 120 aa, Homo sapiens
LPVPLESVKEMLKSVMQELEDYSEGGPLYKNGSLRNADSEIKHSTPSPTKYSLSPSKSYKVNRKEWNHFIVKLFLSVLNALLLFLFFFLVFSQNTTSMGRRSEFFTENDLPRSKGHYETK

SEQ ID NO: 772037 - protein, 104 aa, Homo sapiens
MNSFQIKIHSVHAEKPVPLSDKFVCARDERANQTRGACNQTPRGPNTGLPRAQECRVILLKEVPTPKSSIEMLAWVETSPLPALSLNQKGRPAGAVEIKPRACG

SEQ ID NO: 772038 - protein, 638 aa, Homo sapiens
AQNAPAMGIRGMLRAAVILLLIRTWLAEGNYPSPIPKFHFEFSSAVPEVVLNLFNCKNCANEAVVQKILDRVLSRYDVRLRPNFGGAPVPVRISIYVTSIEQISEMNMDYTITMFFHQTWKDSRLAYYETTLNLTLDYRMHEKLWVPDCYFLNSKDAFVHDVTVENRVFQLHPDGTVRYGIRLTTTAACSLDLHKFPMDKQACNLVVESYGYTVEDIILFWDDNGNAIHMTEELHIPQFTFLGRTITSKEVYFYTGSYIRLILKFQVQREVNSYLVQVYWPTVLTTITSWISFWMNYDSSAARVTIGLTSMLILTTIDSHLRDKLPNISCIKAIDIYILVCLFFVFLSLLEYVYINYLFYSRGPRRQPRRHRRPRRVIARYRYQQVVVGNVQDGLINVEDGVSSLPITPAQAPLASPESLGSLTSTSEQAQLATSESLSPLTSLSGQAPLATGESLSDLPSTSEQARHSYGVRFNGFQADDSIFPTEIRNRVEAHGHGVTHDHEDSNESLSSDERHGHGPSGKPMLHHGEKGVQEAGWDLDDNNDKSDCLAIKEQFKCDTNSTWGLNDDELMAHGQEKDSSSESEDSCPPSPGCSFTEGFSFDLFNPDYVPKVDKWSRFLFPLAFGLFNIVYWVYHMY

SEQ ID NO: 772039 - protein, 86 aa, Homo sapiens
AQNAPAMGIRGMLRAAVILLLIRTWLAEGNYPSPIPKFHFEFSSAVPEVVLNLFNCKNCANEAVVQKILDRVLSRYDVRLRPNFGV

SEQ ID NO: 772040 - protein, 100 aa, Homo sapiens
AESDGVCLRPAFLWAFEAPSQKARTRWAQERHPSSQANQNSGHLREDGTVPCDPAQEPSSSTASSRIASPNSTRAMSPEARGCLCPSRTEKERGERETGV

SEQ ID NO: 772041 - protein, 541 aa, Homo sapiens
GAAGCVAGMSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 772042 - protein, 491 aa, Homo sapiens
MLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIGTKGPHEGWTGKLSKNKRKKMRRKRKQQKRLLEERLRDLQRLEAMEAATQAEDSGLRLDGGSGSTSSSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 772043 - protein, 166 aa, Homo sapiens
TALAPARPQGSPCFQHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 772044 - protein, 574 aa, Homo sapiens
GAAGCVAGMSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 772045 - protein, 574 aa, Homo sapiens; identical to SEQ ID NO: 772044

SEQ ID NO: 772046 - protein, 336 aa, Homo sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTGQPTNQSMDDTREDIYVNYPTFSRRPKTRV

SEQ ID NO: 772047 - protein, 351 aa, Homo sapiens
MFLSKPSVYICLFTCVLQLSHSWSVNNFLMTGPKAYLIYSSSVAAGAQSGIEECKYQFAWDRWNCPERALQLSSHGGLRSANRETAFVHAISSAGVMYTLTRNCSLGDFDNCGCDDSRNGQLGGQGWLWGGCSDNVGFGEAISKQFVDALETGQDARAAMNLHNNEAGRKAVKGTMKRTCKCHGVSGSCTTQTCWLQLPEFREVGAHLKEKYHAALKVDLLQGAGNSAAARGAIADTFRSISTRELVHLEDSPDYCLENKTLGLLGTEGRECLRRGRALGRWELRSCRRLCGDCGLAVEERRAETVSSCNCKFHWCCAVRCEQCRRRVTKYFCSRAERPRGGAAHKPGRKP

SEQ ID NO: 772048 - protein, 573 aa, Homo sapiens
DDQSIGRTWAHSLQEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLALRPFDASVHSTPPAIHSLRPFTPPAIQRLRPFNASA

SEQ ID NO: 772049 - protein, 1403 aa, Homo sapiens
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPGPAPGPAPFVPRERASVDRWRRTKGAGPPGGAGLADGFHRYYGPIEPQGLGLGLGEARAAPRGAAGRPLSPPAAQPPQKPPASYFAIVRDKEPAEPPAGAFPGFPSPPAPPAAAATAVGPPLCRLAFEDESPPAPARWPRSDPESQPLLGPGAGGAGGTGGAGGGAPAAPPPCCAAPPPCPYLDLEPSPSDSEDSESLGGASLGGLDPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEVMTRPRGPHRPLGQRRPRPEGAPAVDRTRVGWEGKQWNWPDPAWSSVLRPLVLEEPQAGEDLVPQLSP

SEQ ID NO: 772050 - protein, 35 aa, Homo sapiens
MLLLLALACASPFPEEAPGPGGAGGPGGGLGGARP

SEQ ID NO: 772051 - protein, 196 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCIT

SEQ ID NO: 772052 - protein, 125 aa, Homo sapiens
MGNIFEKLFKSLLGKKKMRILILSLDTAGKTTILYKLKLGETVPAVPTVGFCVETVEYKNNTFAVWDVGSHFKIRPLWQHFFQNTKELSASQFAQFIKKLCGVTGTNDEASPGSLTSYPSHLLDR

SEQ ID NO: 772053 - protein, 125 aa, Homo sapiens; identical to SEQ ID NO: 772052

SEQ ID NO: 772054 - protein, 125 aa, Homo sapiens; identical to SEQ ID NO: 772052

SEQ ID NO: 772055 - protein, 55 aa, Homo sapiens
EDTFAIHRHLLRERNPLTPASEPRFYEILKVMQEAADRHTQTLPEVPMNSEVPMN

SEQ ID NO: 772056 - protein, 583 aa, Homo sapiens
MPLRKMKIPFLLLFFLWEAESHAASRPNIILVMADDLGIGDPGCYGNKTIRTPNIDRLASGGVKLTQHLAASPLCTPSRAAFMTGRYPVRSGMASWSRTGVFLFTASSGGLPTDEITFAKLLKDQGYSTALIGKWHLGMSCHSKTDFCHHPLHHGFNYFYGISLTNLRDCKPGEGSVFTTGFKRLVFLPLQIVGVTLLTLAALNCLGLLHVPLGVFFSLLFLAALILTLFLGFLHYFRPLNCFMMRNYEIIQQPMSYDNLTQRLTVEAAQFIQRNTETPFLLVLSYLHVHTALFSSKDFAGKSQHGVYGDAVEEMDWSVGQILNLLDELRLANDTLIYFTSDQGAHVEEVSSKGEIHGGSNGIYKGGKANNWEGGIRVPGILRWPRVIQAGQKIDEPTSNMDIFPTVAKLAGAPLPEDRIIDGRDLMPLLEGKSQRSDHEFLFHYCNAYLNAVRWHPQNSTSIWKAFFFTPNFNPVGSNGCFATHVCFCFGSYVTHHDPPLLFDISKDPRERNPLTPASEPRFYEILKVMQEAADRHTQTLPEVPDQFSWNNFLWKPWLQLCCPSTGLSCQCDREKQDKRLSR

SEQ ID NO: 772057 - protein, 583 aa, Homo sapiens; identical to SEQ ID NO: 772056

SEQ ID NO: 772058 - protein, 583 aa, Homo sapiens; identical to SEQ ID NO: 772056

SEQ ID NO: 772059 - protein, 583 aa, Homo sapiens; identical to SEQ ID NO: 772056

SEQ ID NO: 772060 - protein, 583 aa, Homo sapiens; identical to SEQ ID NO: 772056

SEQ ID NO: 772061 - protein, 109 aa, Homo sapiens
PFIRSALRDSSAASGALPSIERTAATRRTSDEIQTPSQSCKLPHDPAAVRLSKPPIPPLSLVCCSQTGLLTVSRKPHAHYSLKHLTCSLCLGCFASSVSRAASFSSFRS

SEQ ID NO: 772062 - protein, 738 aa, Homo sapiens
MLERPKEPGLGRVLCKLLKEWNLIRISGNLLKILKNNTMKTNILYFSVLEKAPDYCVNYGLEGHKSRGSGTVEISYFFFPVLNFAFYSFFLFLTAMTSLSFVKVIHDCYKIDIVETEKQSQNSTTQKSEIFCIWICLSRRVDCLIKRQSFINVEANMTYMLPLNNKKLNLLLSQDKIKIGGVKLKKLLKFGWCFFKARDLESQSFLSQVSIFISGKFSAILSEVNFFFLRNANYVKSLLSLYNSPQLFWQQARVRVGEWFSDEIVPSQIIRHESILIRSGQPCMPSYENLNAAANLTGGRAQAIMLNGCHSPPVVLPNSYQVMDKYWSVAQGLGTTALYLFTVFFVTTLVSLKFSLTFVNHNPSEFSVVIILFVTSNVLFNFIMVNFVFHCFLGHCHFIFLLFLYFYHCFIEISSLSFSCFSINEIMSIIFFETTETYLYKLFLYFLKKFLSGVSFICFFIEVLSPLPIFGAGFFLLITEQSQLFTELQCGKWWEGESDQPTEAIEISGFKPTSPKPFYVFFLLPRHHIFISIFDIWAAYVVHSVKLSVSTFFMLLLVIIACSPTPFPTLALVFYIIQQACSQLSNIVYQNFYLYLYISTIRKYIVKSYEDRFCLFLACLHSILQRFQTNHLCLKHRRIMILIEIYILPKIYASQFPFSYSVQMATYLKAADYEFVINYLLITDMVFIFFSQFFIMLFLETVLGGEWIINIFISPPLTESPYVICTSNRPGIDQSIFY

SEQ ID NO: 772063 - protein, 108 aa, Homo sapiens
MKLQTLLAEFSTSLSSLGFPTTSKSWKTQGRAPGAMASPSRSSEATGKPRGRDGRPRREEDDVPPEEKRLRLLLEGGSAQPQDGEDGEDAPRPGRVETGTQTGGDGRG

SEQ ID NO: 772064 - protein, 66 aa, Homo sapiens
RRAAEGGVIIQTVSERVELVIKAGAEPRGKICSTKLIPVDQNKEQNAESINIPPAIHFQGESVTPS

SEQ ID NO: 772065 - protein, 152 aa, Homo sapiens
QVPPQRVLSCSLGRPRSRSHCRAREMLPRAAWSLVLRKGGGGRRGMHSSEGTTRGGGKMSPYTNCYAQRYYPMPEEPFCTELNAEEQALKEKEKGSWTQLTHAEKVALFPPKPITLTDERKAQQLQRMLDMKVNPVQGLASRWDYEKKQWKK

SEQ ID NO: 772066 - protein, 196 aa, Homo sapiens
QVPPQRVLSCSLGRPRSRSHCRAREMLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 772067 - protein, 154 aa, Homo sapiens
MGRWHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 772068 - protein, 1800 aa, Homo sapiens
AQPSVVTRRSPSRGHPSRTFRVASDQGHQSMANWGSQNLAQPSMDSGEPSSLAQPSQAPGVTSNLAQPSQAFGVSPSPDYPSQSVGEYPMLAQPFQPTEVSPSPTYPSQAIREYPTLAQPFQPTEVSPSPAHPYQLTEVSPSAAYSYQPTEVSPNPGYLSMAIEMSPSPEYPSVATEVSPSPTYPYQPTEISPSSGYLSVATEVSPSPGYPSQLTEVSPSSGYLSVATEVSPSPDYSSQPTEMSPSSGYLSMATEVSPSPGYPFQPTEVSPSPDYPCVATGESPSLAQPSQPTEVSPSSAYPSVVTGESPSLAQSYQRTEVFPSPAYPFMATEVSPSPGDPSVVTGESPSPAYPSQPTGESPSLTQPSLTIRVSPSLAMSSQTIGVSPSLAMPSQTIGVSPSLAMPFHTIGVSPTLAHPSMAIRESPSLAQPPQSTGESPSLTWPSQATGVSPSVAHQSVASRVSSSLAQPSQASGMSPRQDYPPVASRVSPNQAHASITSRMSPSRAHASMTCMVSPSQVHRSMPSEVSPSLAQLSQATTAVPLRPAHQPMACGVSPSLAQPSQATGMSSRLAHQPMTCVVSLSPAQPSQAIGVSPSLAHPSGPHGLSPSLAHPYVASGAGSSLAHPSQTTAVSPRQAQPSVASSPGKTNSSCTLASSLAEPAIAPSLFPPSVAHTEALSLAQSPPDTRLAPSRSQPSVVSGTCHGLNEPCWGSRLDSNLQCSRVDSVAPCLCHPSAFVSVSLGGPYPSVAGNMDQGLNQPSLGTGVNLCEEPLMVSEMVSSPPDFKFNDVSLGFHHPPRVGGRHVCPPSVVSVSTPNLSHADEEACCVGQGITPLFRGVAVSHPQEPLADAMFPSGSQGTTSPGLAGNLPWRTIATGMGQSQCQVANGMASLASQVLEAGGPLTHPSGTTGMAPSPSLASVPNRLAVTQSNLSLNSMDPSSSQISVVIPKNIDCWHPSEASMVPPSYQQRDVIPQDSLKSRAGRGAAGGFVASRMSTGAVPGTLPGGITSSLPPGSTIRGMGHSLPAGSVSSWVAPSLMADRKKPSLSVRPSASLAAPNLLPGSVVSRVSPVVPPGSVPMMGASSVAQSCSKGPMVIDITAPPYLKALAGERSLAPLQMPHTTSLAPGHSSAPAASGTVRSLHRVPTVLSRALQLSQDARIMPSGVTGDQAKLGELDEAVFQVSGSSGSNDLFSKARVTGATQWMYSSPLGADGGHDHRSLSEKGSLPQGRWLPAMLSGMVPVPFQAPGLATKSPSVYQQGSVTHVIPPNHSQGTVASNVVSGSPQLARGSTEAFRLLSVSVGRMGNPSLLQRSGTTSMVSHVPLYPSSARRALSSPFQTEAVPNPLQKTVSGNMAPSSRWDAMGPKNSYRSVHGRIVPELLESSVARVRPLQYVQRQPSQASARSGANPTHRPSAEVRPVIRTGEMTHSSVIPPLAPGVRRVSLGYESSPSGSLPPLFNQESPWRRQDSYSPQNPAVSHKASLNSTILQGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 772069 - protein, 1180 aa, Homo sapiens
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 772070 - protein, 817 aa, Homo sapiens
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWPSQRTDRPMGTSWEALMALWV

SEQ ID NO: 772071 - protein, 1595 aa, Homo sapiens
AQPSVVTRRSPSRGHPSRTFRVASDQGHQSMANWGSQNLAQPSMDSGEPSSLAQPSQAPGVTSNLAQPSQAFGVSPSPDYPSQSVGEYPMLAQPFQPTEVSPSPTYPSQAIREYPTLAQPFQPTEVSPSPAHPYQLTEVSPSAAYSYQPTEVSPNPGYLSMAIEMSPSPEYPSVATEVSPSPTYPYQPTEISPSSGYLSVATEVSPSPGYPSQLTEVSPSSGYLSVATEVSPSPDYSSQPTEMSPSSGYLSMATEVSPSPGYPFQPTEVSPSPDYPCVATGESPSLAQPSQPTEVSPSSAYPSVVTGESPSLAQSYQRTEVFPSPAYPFMATEVSPSPGDPSVVTGESPSPAYPSQPTGESPSLTQPSLTIRVSPSLAMSSQTIGVSPSLAMPSQTIGVSPSLAMPFHTIGVSPTLAHPSMAIRESPSLAQPPQSTGESPSLTWPSQATGVSPSVAHQSVASRVSSSLAQPSQASGMSPRQDYPPVASRVSPNQAHASITSRMSPSRAHASMTCMVSPSQVHRSMPSEVSPSLAQLSQATTAVPLRPAHQPMACGVSPSLAQPSQATGMSSRLAHQPMTCVVSLSPAQPSQAIGVSPSLAHPSGPHGLSPSLAHPYVASGAGSSLAHPSQTTAVSPRQAQPSVASSPGKTNSSCTLASSLAEPAIAPSLFPPSVAHTEALSLAQSPPDTRLAPSRSQPSVVSGTCHGLNEPCWGSRLDSNLQCSRVDSVAPCLCHPSAFVSVSLGGPYPSVAGNMDQGLNQPSLGTGVNLCEEPLMVSEMVSSPPDFKFNDVSLGFHHPPRVGGRHVCPPSVVSVSTPNLSHADEEACCVGQGITPLFRGVAVSHPQEPLADAMFPSGSQGTTSPGLAGNLPWRTIATGMGQSQCQVANGMASLASQVLEAGGPLTHPSGTTGMAPSPSLASVPNRLAVTQSNLSLNSMDPSSSQISVVIPKNIDCWHPSEASMVPPSYQQRDVIPQDSLKSRAGRGAAGGFVASRMSTGAVPGTLPGGITSSLPPGSTIRGMGHSLPAGSVSSWVAPSLMADRKKPSLSVRPSASLAAPNLLPGSVVSRVSPVVPPGSVPMMGASSVAQSCSKGPMVIDITAPPYLKALAGERSLAPLQMPHTTSLAPGHSSAPAASGTVRSLHRVPTVLSRALQLSQDARIMPSGVTGDQAKLGELDEAVFQVSGSSGSNDLFSKARVTGATQWMYSSPLGADGGHDHRSLSEKGSLPQGRWLPAMLSGMVPVPFQAPGLATKSPSVYQQGSVTHVIPPNHSQGTVASNVVSGSPQLARGSTEAFRLLSVSVGRMGNPSLLQRSGTTSMVSHVPLYPSSARRALSSPFQTEAVPNPLQKTVSGNMAPSSRWDAMGPKNSYRSVHGRIVPELLESSVARVRPLQYVQRQPSQASARSGANPTHRPSAEVRPVIRTGEMTHSSVIPPLAPGVRRVSLGYESSPSGSLPPLFNQESPWRRQDSYSPQNPAVSHKASLNSTILQGPADAGVVGGQSWNRAWEPARGAASWDTWRNKAVVPPRRSGEPMVSMQAAEEIRILAVITIQAGVRGYLARRRIRLPAGCPESQAAASPGQSGHSHPVRLEGL

SEQ ID NO: 772072 - protein, 372 aa, Homo sapiens
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWLSYLKSVFNPIVYCWRIKKFREACIELLPQTFQILPKVPERIRRRIQPSTVYVCNENQSAV

SEQ ID NO: 772073 - protein, 279 aa, Homo sapiens
ILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNN

SEQ ID NO: 772074 - protein, 500 aa, Homo sapiens
DEEFSRTRVAGRSRALARGNGALAVGAGLKGGERPGSLEAELGELPHAGRGSGGSGICSSDSARHSRCSSLHSGGPAALRGSRGSAGCSDLARGRPGLSLPRWGLDGRGTGNMEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 772075 - protein, 392 aa, Homo sapiens
PGEGDGLMRPALGTKDVEEQASLWARPRLNHVACLSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 772076 - protein, 449 aa, Homo sapiens
DEEFSRTRVAGRSRALARGNGALAVGAGLKGGERPGSLEAELGELPHAGRGSGGSGICSSDSARHSRCSSLHSGGPAALRGSRGSAGCSDLARGRPGLSLPRWGLDGRGTGNMEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSEWPLCCTRLGPPTATGLGEQSMHLLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 772077 - protein, 164 aa, Homo sapiens
MKSKNFCHSSPQLFFFFFFFLNSRVFGETGVVGSMENFLRGGFPKFGGPLPPEQGYNFNTQIVVCLYYSLTPPSQHFFPKVCGKGSMWIPHYFLALMENPTRYRGRNWDNITTDVGILITAASHQPLLSLGNGKCRGPPRRGPPGWKTSVKNDLSGAGGAGNQD

SEQ ID NO: 772078 - protein, 49 aa, Homo sapiens
CQSGIVVEIQAGRGLALLASYRAQAMWPCGQTMAVFELSIRAHCTQRPA

SEQ ID NO: 772079 - protein, 129 aa, Homo sapiens
VERWTRRLRASLAGQVGGTGLRIPRPRFGPAGDMASSGEVLSATVSALLLPRRPRSPWVLPSRPGFPCILSIPTPTPPRPSHPDPGLAPAPVLPASCPQDSYPVSEGTSCLPLRSCIPDRQSCPRLSVP

SEQ ID NO: 772080 - protein, 690 aa, Homo sapiens
VERWTRRLRASLAGQVGGTGLRIPRPRFGPAGDMASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRSFQAERPALNVVIFPLLHEGLTDVIRDVPLVHLDEITLFKSRVAEEPPNLWW

SEQ ID NO: 772081 - protein, 690 aa, Homo sapiens; identical to SEQ ID NO: 772080

SEQ ID NO: 772082 - protein, 184 aa, Homo sapiens
MWGVTHFKTSQEDGLTAGVIRAPERGVRPAKGAAGHERPECSCPCRWGEVTGRRPQLFTELREEPSARTSRATGRRQPCLPDSGVVCCPCGRPLAVSGIILVGVSPSLVVKTTCVYRVLFKNLDYASIFFLVCLFETESHSVVQAGVQWRDLSSLQPLLSGLQPQPPEQLENELEIGFSYCFVI

SEQ ID NO: 772083 - protein, 475 aa, Homo sapiens
VERWTRRLRASLAGQVGGTGLRIPRPRFGPAGDMASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLSVADSAPRADRAPAQPAMHAVPRGFGKKVRVGVQSCPSPFSGQACPQPSSVFWSLLKNLPSLGRSMRVPGEIDTHSALLE

SEQ ID NO: 772084 - protein, 777 aa, Homo sapiens
VERWTRRLRASLAGQVGGTGLRIPRPRFGPAGDMASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRRWGEVTGRRPQLFTELREEPSARTSRATGRRQPCLPDSGVVCCPCGRPLAVSGIILVGVSPSLVVKTTCVYRVLFKNLDYASIFFLVCLFETESHSVVQAGVQWRDLSSLQPLLSGLQPQPPEQLENELEIGFSYCFVI

SEQ ID NO: 772085 - protein, 639 aa, Homo sapiens
VERWTRRLRASLAGQVGGTGLRIPRPRFGPAGDMASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRR

SEQ ID NO: 772086 - protein, 271 aa, Homo sapiens
ELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVP

SEQ ID NO: 772087 - protein, 567 aa, Homo sapiens
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRLILKCSMMPMQVDGEPWAQGPCTVTITHKTHAMMLYFSGEQTDDDISSTSDQEDIKATE

SEQ ID NO: 772088 - protein, 177 aa, Homo sapiens
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRYGLRGHSLSQNAPWESGFHRVV

SEQ ID NO: 772089 - protein, 74 aa, Homo sapiens
MALSPSADLSGLCLLFEPVWLGSLQGVLHPPRPSEEAPGTVLGLPPRPPAAAGAKGPAVPAGPLASSQWLQLSH

SEQ ID NO: 772090 - protein, 314 aa, Homo sapiens
MGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 772091 - protein, 189 aa, Homo sapiens
MPCLLKVADAGCSVGLGKVHCSCHLPNPRVLRHCDILTGVLTLGLDMSCHACLSAGTGLGEELVGLGPGSTCLVNICGCYFPVTGWQVRTTQIHLHSNVLQSSDYVALQQGEGDIHEQVCKMHLMPANGVQPSIALVCPVSVSLSFDTRGQVSLGNSFQFLQFWDSYPSPSTMSIWAHDSSQPIRVHFP

SEQ ID NO: 772092 - protein, 39 aa, Homo sapiens
MLDSFATDEARNQKTCLLFSTSLHSRAIKKSDFVIMLLA

SEQ ID NO: 772093 - protein, 231 aa, Homo sapiens
RLAELNQFHLRGHVTHSPHEIPQILTRDEPISVLIELKKCFPQLFNLILSQWSFPLFLSNAFPQEDAGGAHGELHGGVGWSSQGTSLKMAPPPCSLSELSLLIFSSTPLPPLPASLGFSFGPGVFRAVTAGLEIRMNLGGRVDFDDFVELMTPKLLAETAGMIGVQEMRDAFKEFDTNGDGEITLVELQQAMQRLLGERLTPREISEVVREADVNGDGTVDFEEFVKMMSR

SEQ ID NO: 772094 - protein, 217 aa, Homo sapiens
GEAKRGRKRWQRSAGEDKEAELRQGAGRRGHLETGALRAPPHPSMQFPMGPACIFLRKGIAEKQRERPLGQDEIEELREAFLEFDKDRDGFISCKDLGNLMRTMGYMPTEMELIELGQQIRMNLGGRVDFDDFVELMTPKLLAETAGMIGVQEMRDAFKEFDTNGDGEITLVELQQAMQRLLGERLTPREISEVVREADVNGDGTVDFEEFVKMMSR

SEQ ID NO: 772095 - protein, 483 aa, Homo sapiens
APGPCGPRGLPAPASELSPAPERGARRGVAAAMGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 772096 - protein, 72 aa, Homo sapiens
EDLCNPTPGFPLPAVMGITPPSASTLTWVSLRPHLREHVPGAGGSGTGMCCPKLGICGHGVVHSVFPTVHPV

SEQ ID NO: 772097 - protein, 483 aa, Homo sapiens; identical to SEQ ID NO: 772095

SEQ ID NO: 772098 - protein, 447 aa, Homo sapiens
ALRGSRAAVAAAGVPGPCARCWLEGPLGKAPEDPSPCGVGRVGVGRRRGPGPHVPPQALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPLSFLLCEEVGAGQDAPRTPAACCRHPVIRGAPPSLCGGQALLCAPSRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 772099 - protein, 142 aa, Homo sapiens
GRKGAEEAERRARDKQVGGGAEAGVALRTRPGAGSGVRAVPGARPRTGETWAAMAARVTGGQESQSLPSLHDVWGSRWGEPLLVSHAEWRVGESEFLVLGWEPCGGSMFRAGGAGRVGGAGPRRPGLGVPGSGNAVPRLDEL

SEQ ID NO: 772100 - protein, 543 aa, Homo sapiens
APGPCGPRGLPAPASELSPAPERGARRGVAAAMGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSQLCEKRSSAPRTHSGDKARGVGLCRELWSQAGHPQWPGPFPSGLVAVLTADLANRLASGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 772101 - protein, 419 aa, Homo sapiens
GNRITGHKAGSPQEGLELGKKGSAGSGLELQPRCPLGSAFPSWLEGPLGKAPEDPSPCGVGRVGVGRRRGPGPHVPPQALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 772102 - protein, 331 aa, Homo sapiens
MSGVIGEGVQLYDLTLREEYQEDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 772103 - protein, 146 aa, Homo sapiens
SNMAAPSGGVNCEEFAEFQELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 772104 - protein, 140 aa, Homo sapiens
KELVSVMDLSLAKELLKVMRTIDDRIVHELNTTVPTASFAGKIDASQTCKQLYESLMAAHASRDRVIKNCIAQTSAVVKNLREEREKNLDDLTLLKQLRKEQTKLKWMQSELNVEEVVNDRSWKVFNERCRIHFKPPKNE

SEQ ID NO: 772105 - protein, 146 aa, Homo sapiens; identical to SEQ ID NO: 772103

SEQ ID NO: 772106 - protein, 829 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLTTNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 772107 - protein, 675 aa, Homo sapiens
MGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 772108 - protein, 824 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 772109 - protein, 298 aa, Homo sapiens
LIYIFEDLITVSAEGCSTIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 772110 - protein, 324 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQ

SEQ ID NO: 772111 - protein, 290 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLGLVCMANSISLTLMRTFHNNCWTKRDTHLWTHNISWARRNKHSESPRHVRYRYQLVPKSITDPQPVDPWQGLNAAPRRTCNTQHNTQARTPQPGNPR

SEQ ID NO: 772112 - protein, 847 aa, Homo sapiens [sequence omitted]

SEQ ID NO: 772113 - protein, 847 aa, Homo sapiens [sequence omitted]

SEQ ID NO: 772114 - protein, 804 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLESIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 772115 - protein, 744 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVGKLLGRLLVTFRKSN

SEQ ID NO: 772116 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 772117 - protein, 374 aa, Homo sapiens; identical to SEQ ID NO: 772116

SEQ ID NO: 772118 - protein, 503 aa, Homo sapiens
VGVGVDVGMGVAVGVCGRGHGCGGLTPFALFLPSADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVSPAHGCVGRL

SEQ ID NO: 772119 - protein, 627 aa, Homo sapiens
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 772120 - protein, 184 aa, Homo sapiens
RRGPEGCPRWRRPGRAGVTASVLAGEGGLEVRGHGHRPHLPLDVHHRLPAGDGGPLPAALAGWHDLGRDREPAWPGAAVHGASIHAAGLGPGWLLPGLCGATRLPNFPSCSVSAVRRPWTGTRPLGRPSVELLPVGLWPQEAVAWSRGGGRRLLPAGLGLSPVQESPELPCRWNSLLPVSQQIW

SEQ ID NO: 772121 - protein, 627 aa, Homo sapiens; identical to SEQ ID NO: 772119

SEQ ID NO: 772122 - protein, 145 aa, Homo sapiens
GGKGSCEELKEVDVLGRGLGQPGELLDSSRLLSRLHLSPGLPLPAASSHVETRAHAEERLLKKLFSGYNKWSRPVANISDVVLVRFGLSIAQLIDVVGEGVASCTVTEVALQGAQGSGWAEGTQPSTLPVAVSVRPGLVRQNDSH

SEQ ID NO: 772123 - protein, 116 aa, Homo sapiens
MMTTNVWVKQVSGRALPCPTPALPHTPHPAALSWPCPTLALLRTQVLCLRSLGEQSFVELVPRGENREAHAGPGSPPAQALRGGQEHPAPASLETRTLPSRRRARALAGGQGSTGA

SEQ ID NO: 772124 - protein, 161 aa, Homo sapiens
MRGSCERSGEDEEQKEEAMVACGRLSGVPEAEQGPEANWDSDLETEGTDGLGELVRDTLYLRSCRAHSVVPISCFLRQGSAQELNLRHRGLGPQGARALASSLSSNPYVKRLDLRDNGLCGAGAEALAGALSKSSSIHGRCWVWGRWAGVSSFSSGMCLHR

SEQ ID NO: 772125 - protein, 36 aa, Homo sapiens
MMFLGTGSVCGSGASRQALLLTPWKGLPPGAVLTKA

SEQ ID NO: 772126 - protein, 61 aa, Homo sapiens
ISVDPLPLVGPAESLGTAASLLKKENKKPKTLCGRRDKAPWVRREGTRRSAEPRTRVAAAE

SEQ ID NO: 772127 - protein, 487 aa, Homo sapiens
SGRLELESRTTASPTLPRLFTPRHPQTPAQAGAHKPASAPAVLARTRRAPSEPGSAPSSLRPSSQPQSPPGRVGVKMKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 772128 - protein, 394 aa, Homo sapiens
SGRLELESRTTASPTLPRLFTPRHPQTPAQAGAHKPASAPAVLARTRRAPSEPGSAPSSLRPSSQPQSPPGRVGVKMKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKVTILCFPFGCLLRELNRVNSNKAVCFLQ

SEQ ID NO: 772129 - protein, 152 aa, Homo sapiens [sequence omitted]

SEQ ID NO: 772130 - protein, 487 aa, Homo sapiens; identical to SEQ ID NO: 772127

SEQ ID NO: 772131 - protein, 487 aa, Homo sapiens; identical to SEQ ID NO: 772127

SEQ ID NO: 772132 - protein, 167 aa, Homo sapiens
SGRLELESRTTASPTLPRLFTPRHPQTPAQAGAHKPASAPAVLARTRRAPSEPGSAPSSLRPSSQPQSPPGRVGVKMKAARFVLRSAGSLNGAGLVPREVEHFSRYSPSPLSMKQLLDFGSENACERTSFAFLRQELPVRLANILKEIDILPTQLVNTSSVQLVKSW

SEQ ID NO: 772133 - protein, 487 aa, Homo sapiens; identical to SEQ ID NO: 772127

SEQ ID NO: 772134 - protein, 315 aa, Homo sapiens [sequence omitted]

SEQ ID NO: 772135 - protein, 487 aa, Homo sapiens; identical to SEQ ID NO: 772127

SEQ ID NO: 772136 - protein, 334 aa, Homo sapiens
SGRLELESRTTASPTLPRLFTPRHPQTPAQAGAHKPASAPAVLARTRRAPSEPGSAPSSLRPSSQPQSPPGRVGVKMKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKV

SEQ ID NO: 772137 - protein, 371 aa, Homo sapiens
LRGVPIRQPDSLKYPFSNHSTNASMSLLCRNKGCGQHFDPNTNLPDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 772138 - protein, 286 aa, Homo sapiens
MSLLCRNKGCGQHFDPNTNLPDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVSEDQGTQEWEADG

SEQ ID NO: 772139 - protein, 180 aa, Homo sapiens
MSLLCRNKGCGQHFDPNTNLPDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEG

SEQ ID NO: 772140 - protein, 224 aa, Homo sapiens
MALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 772141 - protein, 237 aa, Homo sapiens [sequence omitted]

SEQ ID NO: 772142 - protein, 204 aa, Homo sapiens [sequence omitted]

SEQ ID NO: 772143 - protein, 183 aa, Homo sapiens
ETGSRCVAQAGLELLGSSDSSASASQSAGITDVSHRARPHFCCLDETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 772144 - protein, 147 aa, Homo sapiens
MTSEITYAEVRFKNEFKSSGINTASSAETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPEMMKIHL

SEQ ID NO: 772145 - protein, 83 aa, Homo sapiens
DMLRGLRSCLRIKVPLTFSPKYREALSLEFPNLIEKTSFQKKQNCLPPLSEISSSSEKKTEEGNYAWMDFSQDDACFSGSFKF

SEQ ID NO: 772146 - protein, 197 aa, Homo sapiens
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 772147 - protein, 122 aa, Homo sapiens
MPPASIFKNLVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGTGGIDKHRVRSS

SEQ ID NO: 772148 - protein, 304 aa, Homo sapiens
MPPASIFKNLVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNRSDVPFWAIKNSWGTDWGEKGYYYLHRGSGACGVNTMASSAVVD

SEQ ID NO: 772149 - protein, 214 aa, Homo sapiens
GRGLDTCQAGAAATLISTQVPSWGPLFSPPPRELAMVCHAQAPALLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNRSDVPFWAIKNSWGTDWGEKGYYYLHRGSGACGVNTMASSAVVD

SEQ ID NO: 772150 - protein, 288 aa, Homo sapiens
MPPASIFKNLVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNREFRCLSCIQPGHSEGWDHSISGPLEGK

SEQ ID NO: 772151 - protein, 304 aa, Homo sapiens; identical to SEQ ID NO: 772148

SEQ ID NO: 772152 - protein, 330 aa, Homo sapiens
MPPASIFKNLVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQGEHLALLLCPQPTPQEGFLGPAFCLLELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNRSDVPFWAIKNSWGTDWGEKGYYYLHRGSGACGVNTMASSAVVD

SEQ ID NO: 772153 - protein, 172 aa, Homo sapiens
MPPASIFKNLVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQGEHLALLLCPQPSPSGGLLGTSLLSPRALGL

SEQ ID NO: 772154 - protein, 304 aa, Homo sapiens; identical to SEQ ID NO: 772148

SEQ ID NO: 772155 - protein, 116 aa, Homo sapiens
PDLKAGTPICSHPFHLWEGGSAGQEMCFSCPWSPLNKPMSVYPHPARVPGVDFLPPQTPKATGGCSLHRFRPGLGTSSGIAKLPSYSIAKTTAPRGLASSSNRQVLTAPPGAQGSQ

SEQ ID NO: 772156 - protein, 594 aa, Homo sapiens
MAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSTIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVWAMLLTGIAYGLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 772157 - protein, 124 aa, Homo sapiens
QVSVLISLLRSYPDPCCSASVFIPGSVCTRTCLLASSRFTVSYTYFTLSLRMRELGVSVHFRHVVPSIMEVPARLCCIFLLQQIGRKWSLAVTLLQAIIWCLLLLFLPEGTAHPSPVACPQPSC

SEQ ID NO: 772158 - protein, 111 aa, Homo sapiens
QSQCQHHPLAACPHCWILGWNSTRRDSQPQSPHWGEKGPGPGHCHLPPTPVHRDHSEKSLGHVAAAGAPRCKGEDSPRKGWASAQTGLPEKAGDQVPGGQDSALVGPEDRG

SEQ ID NO: 772159 - protein, 148 aa, Homo sapiens
MHITPCLQHRALLAATDTQATPWSAPHVGVSRASQTHVSSTHPANHTHPFSANGTPLLTPEPYMTSGPSPSPRSVPWPPAPAEGQHWPRVPALCAWKPLPLRVPNLPSVPGLARGQCCPGRKRKPRSRPTWPWLVSPLGGVLQPSAWC

SEQ ID NO: 772160 - protein, 289 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLGGSQRALRLSLAGPILSLCLLPSL

SEQ ID NO: 772161 - protein, 366 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 772162 - protein, 67 aa, Homo sapiens
GGPPPKKSAPSAVVRSNNWMRGQGPISCGRENYGGPTRRRPISSWRNDHMSLRDDGYATKERNHPSS

SEQ ID NO: 772163 - protein, 37 aa, Homo sapiens
GRLSSRSERAALRSSAHWSRPVSPGPSRGQTRGVASR

SEQ ID NO: 772164 - protein, 147 aa, Homo sapiens
MCTPIRGLLMALAVMFGTAMAFAPIPRITWEHREVHLVQFHEPDIYNYSALLLSEDKDTLYIGAREAVFAVNALNISEKQHEVYRKGLRKTRKTQMVQKTGETKHEQSGSTTSRGAAGNQEAEYGYVSGDQGIQAGLVTPEHNILNT

SEQ ID NO: 772165 - protein, 541 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 772166 - protein, 392 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTGNTYNAGISYLMFSLRNQINRH

SEQ ID NO: 772167 - protein, 541 aa, Homo sapiens; identical to SEQ ID NO: 772165

SEQ ID NO: 772168 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPADFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 772169 - protein, 106 aa, Homo sapiens
GRVGPTHASATLFIFQIPTAYQGLMRWYISSTSGQAENILIQRYCYVNEFPSSHIVIFERMNTLSVLNPLLTNDLFSEYYICIESTDSPLVTAPFARQRNGCIKLH

SEQ ID NO: 772170 - protein, 106 aa, Homo sapiens; identical to SEQ ID NO: 772169

SEQ ID NO: 772171 - protein, 78 aa, Homo sapiens
FCSGSPKPSSAPSVPYGLAWQHSRTPRNPYKRGQGPTEATALRFGGQGARGTSLNNYHAVISQHHGHILTLTVRILSQ

SEQ ID NO: 772172 - protein, 75 aa, Homo sapiens
PHLHGDNGLSPESGAVGALGIGWHNRPLCRLQRAGGSTSRGLTEMWSGPSPILMASKSWGAWCPVEREPGLGLAC

SEQ ID NO: 772173 - protein, 431 aa, Homo sapiens
MSVRVRLQQGPDWGFLQSFSGSGLPFPGWTHTFILDYHPEEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVSLQDRRASGPVICHHSVRRWPALLPGSAGAGTGLGATGEEAGDGPCASPAGLPKESVSNAEQPGRMGAADREGRRLQSCCCPYQGDPPDRAHPQGPEPAATLPDRPGGGVSAARREHPGPAVCQRHPGVVQAGTEAEASGWGGAELTPDPFSHPLSSPGQATMVPWVLHHPVEPKGLEYNHTTSHTPRVGGWWEGRGPSSLLLKIYAVARRSGSRL

SEQ ID NO: 772174 - protein, 260 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREVSGTFPKQAPKPHPKGEPLSGSGLQSGDGGVSLGKQGQICKLGGCHSNDHGLRLVLPAFSGKNSLPQAQARRLCEERPRGDLLSLGPFTFQPLGLGDPRRHRGPDFLLGPTHLFN

SEQ ID NO: 772175 - protein, 380 aa, Homo sapiens
MTPMKRSVQTQVSEPFMESWGEESLPELPAEQSLTEYSDLEEAPSAHTLYVGHLNPQFSVPVLACLLRDTLERLEMPVAREHIEVVRRPRKAYALVQVTVHRDTLASLPWRLQTALEEHLILKELAARGKDLLLSEAQGPFSHREEKEEEEEDSGLSPGPSPGSGVPLPTWPTHTLPDRPQAQQLQSCQGRPSGVCSDSAIVHQQIVGKDQLFQGAFLGSETRNMEFKRGSGEYLSLAFKHHVRRYVCAFLNSEGGSLLVGVEDSGLVQGIRCSHRDEDRARLLVDSILQGFKPQIFPDAYTLTFIPVISTSETSVPLKVIRLTVHTPKAQSQPQLYQTDQGEVFLRRDGSIQGPLSASAIQEWCRQVRKLRPVGGVERS

SEQ ID NO: 772176 - protein, 260 aa, Homo sapiens; identical to SEQ ID NO: 772174

SEQ ID NO: 772177 - protein, 89 aa, Homo sapiens
MKARKYNSEGFPGSGELALEPAVSVWTGRSPVRKDMGFQGAAGPKPEPSPICPHPVSQWGVRGMVLISRKDTGLIPGGICMGKNPSNVI

SEQ ID NO: 772178 - protein, 137 aa, Homo sapiens
RQAADVLMTFPSPPSLKDDNHNPPRALHTSCSRFIHNRSQDGHHHPGGWPLRRQCASFTDGETEVLTRPSTSQGRDLNSGKSSGFWIGLKLRARLQARSGPMESRPGRVQGPEATPQRCHWGPASVLSLSLRDEAAP

SEQ ID NO: 772179 - protein, 465 aa, Homo sapiens
MNAQLTMEAIGELHGVSHEPVPAPADLLGGSPHARSSVAHRGSHLPPAHPRSMGMASLLDGGSGGGDYHHHHRAPEHSLAGPLHPTMTMACETPPGMSMPTTYTTLTPLQPLPPISTVSDKFPHHHHHHHHHHHPHHHQRLAGNVSGSFTLMRDERGLASMNNLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQVSNGSNSGQMEEINTKEVAQRITTELKRYSIPQAIFAQRVLCRSQGTLSDLLRNPKPWSKLKSGRETFRRMWKWLQEPEFQRMSALRLAACKRKEQEHGKDRGNTPKKPRLVFTDVQRRTLHAIFKENKRPSKELQITISQQLGLELSTVSNFFMNARRRSLDKWQDEGSSNSGNSSSSSSTCTKA

SEQ ID NO: 772180 - protein, 224 aa, Homo sapiens
RPPTTTKFAAASTSRAPALALALAHAMANEVQDLLSPRKGGHPPAVKAGGMRISKKQEIGTLERHTKKTGFEKTSAIANVAKIQTLDALNDALEKEQVQLGVRNERQVQPFHHGCSWKETSGFDTSSEDPERLFLSMCLVTVLGNLLIILAVTPDSHLHIPMCFFLSNLSLPDIGFTSTTVPKMIVDIQSHSRVISYAGCLTQMSLFAIFGGMEERHAPECDGL

SEQ ID NO: 772181 - protein, 107 aa, Homo sapiens
MANEVQDLLSPRKGGHPPAVKAGGMRISKKQEIGTLERHTKKTGFEKTSAIANVAKIQTLDALNDALEKLNYKFPATVHMAHQKPTPALEKVVPLKRIYIIQQPRKC

SEQ ID NO: 772182 - protein, 47 aa, Homo sapiens
GAATAGIQPPEHQHWHWHWHTLWQMKCKTCSPLGKGDILLQVGCHLP

SEQ ID NO: 772183 - protein, 154 aa, Homo sapiens
GRVRRGGMAAAADSFSGGPAGVRLPRSPPLKVLAEQLRRDAEGGPGAWRLSRAAAGRGPLDLAAVWMQGRVVMADRGEARLRDPSGDFSVRGLERVPRGRPCLVPGKYVMVMGVVQACSPEPCLQAVKMTDLSDNPIHESMWELEVEDLHRNIP

SEQ ID NO: 772184 - protein, 90 aa, Homo sapiens
VIGKFPCSLGCLCGWFCGVRPAMERSGPSEVTGSDASGPDPQLAVTMGFTGFGKKARTFDLEAMFEQTRRTAVERSCKTLVQPNGNGLKE

SEQ ID NO: 772185 - protein, 111 aa, Homo sapiens
MVIAHTKALDPSQPVTFVTNSTYAADKGALYVDVIRVNSYYSWYRNYGHLELIQLQLAAQFENWCKTSQSHYSERVWSGNACRVSPDYIYSYQMEIITALKIFIFSFYFTY

SEQ ID NO: 772186 - protein, 325 aa, Homo sapiens
LGRLSFLAPVTGSDASGPDPQLAVTMGFTGFGKKARTFDLEAMFEQTRRTAVERSCKTLGLVNYQISVKCSNQFKLEVCLLKSENKVVDNQAGTQGQLKVLGANLWWPYLMHEHPAYLYSWEMVIAHTKALDPSQPVTFVTNSTYAADKGALYVDVIRVNSYYSWYRNYGHLELIQLQLAAQFENWCKTSQSHYSERVWSGNACRVSPGLVTYQISVKCSNQFKLEVCLLKSGANLWWPYLMHEHPAYLYSWGMVIAHTKALDPSQPVTFVTNSTYAADKGVSLGVPTPFLLPLPGLVPEACSWEQLERTMCCQSELFILFYLER

SEQ ID NO: 772187 - protein, 443 aa, Homo sapiens
LGRLSFLAPVTGSDASGPDPQLAVTMGFTGFGKKARTFDLEAMFEQTRRTAVERSCKTLGLVNYQISVKCSNQFKLEVCLLKSENKVVDNQAGTQGQLKVLGANLWWPYLMHEHPAYLYSWEMVIAHTKALDPSQPVTFVTNSTYAADKGALYVDVIRVNSYYSWYRNYGHLELIQLQLAAQFENWCKTSQSHYSERVWSGNACRVSPGLVTYQISVKCSNQFKLEVCLLKSGANLWWPYLMHEHPAYLYSWGMVIAHTKALDPSQPVTFVTNSTYAADKGVSLGVPTPFLLPLPGLVLKPAHGNSWKEPCAANGVLLCCPGWSAVAQSQLTATSASQALYVDVIRVNSYYSWYRNYGHLELIQLQLAAQFENWCKTSQSHYSERVWSGNACRVSPGSTLMFSEENQKSLLEQYHLGLNQKRRKYVVGELIWNFADFMTNQCK

SEQ ID NO: 772188 - protein, 87 aa, Homo sapiens
VIGKFPCSLGCLCGWFCGVRPAMERSGPSEVTGSDASGPDPQLAVTMGFTGFGKKARTFDLEAMFEQTRRTAVERSCKTLGQITEGY

SEQ ID NO: 772189 - protein, 277 aa, Homo sapiens
VIGKFPCSLGCLCGWFCGVRPAMERSGPSEVTGSDASGPDPQLAVTMGFTGFGKKARTFDLEAMFEQTRRTAVERSCKTLGLVNYQISVKCSNQFKLEVCLLKSENKVVDNQAGTQGQLKVLGANLWWPYLMHEHPAYLYSLGGMVIAHTKALDPSQPVTFVTNSTYAADKGALYVDVIRVNSYYSWYRNYGHLELIQLQLAAQFENWCKTSQSHYSERVWSGNACRVSPGSTLMFSEENQKSLLEQYHLGLNQKRRKYVVGELIWNFADFMTNQCK

SEQ ID NO: 772190 - protein, 269 aa, Homo sapiens
PPTCTRGRMVIAHTKALDPSQPVTFVTNSTYAADKGALYVDVIRVNSYYSWYHNYGHLELIQLQLAAQFENWCKTSQSHYSERVWSGNACRVSPGLVNYQISVKCSNQFKLEVCLLKSENKVVDNQAGTQGQLKVLGANLWWPYLMHEHPAYLYSWEEMVIAHTKALDPSQPVTFVTNSTYAADKGALYVDVIRVNSYYSWYRNYGHLELIQLQLAAQFENWCKTSQSHYSERVWSGNACRVSPDYIYSYQMEIITALKIFIFSFYFTY

SEQ ID NO: 772191 - protein, 87 aa, Homo sapiens; identical to SEQ ID NO: 772188

SEQ ID NO: 772192 - protein, 143 aa, Homo sapiens
MEEALLNLEVQRGSVSIPLRIWCPSPSVSACWSSLMFYLSVPVEGVGRVFLWVCPCGQSVCPPFGSSWSLSPGSASIPAWRGHALCSSVSLRTHVSPLKVYLLLFPVWLEGACPSGNPFAFFEGLGVCGPCLCPWEWCVSIFV

SEQ ID NO: 772193 - protein, 265 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 772194 - protein, 210 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNAIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 772195 - protein, 215 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGIYFTGCSMNPARSFGPAVVMNRFSPAHWVSLSLPLAPWR

SEQ ID NO: 772196 - protein, 185 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGVSSTDIGLG

SEQ ID NO: 772197 - protein, 75 aa, Homo sapiens
MPPYLFLVRMHAWGCWCLEWGLPNKSLILTFRLCLSSECLETLWPIASPLCHPTSSTTISTGYRGPQDKCSVGRK

SEQ ID NO: 772198 - protein, 265 aa, Homo sapiens; identical to SEQ ID NO: 772193

SEQ ID NO: 772199 - protein, 156 aa, Homo sapiens
KVAGLLILYPLQLNNNTTQGQAMVVELILTFQLALCIFASTDSRRTSPVGSPALSIGLSVTLGHLVGIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 772200 - protein, 222 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSRGLLGTGLSGTDLRDCECSAKLTGCKGQARKGWACSLHPPPSPTLPQELKGSQPLGGQRQTLPRAP

SEQ ID NO: 772201 - protein, 166 aa, Homo sapiens
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFALLRKKTDWFIECRLIYFW

SEQ ID NO: 772202 - protein, 313 aa, Homo sapiens
WTSETQEVIGGGTEGLKKYYKELQNQLNEIVELVRGKLSKQTRTTLGALVTIDVHARDVVMDMIKMGVSHDTDFLWLAQLRYYWENENARVRIINCNVKYAYEYLGNSPRLVITPLTDRCYRTLIGAFYLNLGGAPEGPAGTGKTETTKDLAKALAVQCVVFNCSDGLDYLAMGKFFKGLASSGAWACFDEFNRIELEVLSVVAQQILCIQRAIQQKLVVFVFEGTELKLNPNCFVAITMNPGYAGRSELPDNLKVLFRTVAMMVPNYALIAEISLYSYGFLNARPLSVKIVMTYRLCSEQLSSQFHYDYGMR

SEQ ID NO: 772203 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 772204 - protein, 355 aa, Homo sapiens; identical to SEQ ID NO: 772203

SEQ ID NO: 772205 - protein, 103 aa, Homo sapiens
MHPFHRCATAVQRGLLEHEASGSTRVLSWVNFPTWRLEVEVSMKSGGHPVFRTLWPPRPPASFFLSARFPCTAVTLASFHGHAWTPRKPFPETGHERSDLHLI

SEQ ID NO: 772206 - protein, 106 aa, Homo sapiens
MVPPWLWEAGIRECGSVPVSRTLPTLAWWQTWLPAAELPVPLSPQRPGHFLHVSPAHVNCRENQGNPRASWRRHQTPGVPRWAPTHPTLKPGWGLEQGVWFLGAGS

SEQ ID NO: 772207 - protein, 106 aa, Homo sapiens; identical to SEQ ID NO: 772206

SEQ ID NO: 772208 - protein, 106 aa, Homo sapiens; identical to SEQ ID NO: 772206

SEQ ID NO: 772209 - protein, 153 aa, Homo sapiens
MYRPRAFIFSDCHSRVLEQLRGNVLLNGLSLEADITANLDSPRVTVAQLDWDVATVHQLSAFQPDVVIAADVLYCPEAIVSLVGILRRLAACWEHQQAPEVYVAFTVHNPETCQLFTTELGRAGIIWEAEAHHDQKLFPYGEHLEMAMLNLTL

SEQ ID NO: 772210 - protein, 106 aa, Homo sapiens; identical to SEQ ID NO: 772206

SEQ ID NO: 772211 - protein, 169 aa, Homo sapiens
MEALDELYEALAETLMAKESTQGHRSYLLPSGGSVTLSESTAIISHGTTGLVTWDATLYLAEWAIENPAAFTNRTVLELGSGAGLTGLAICKMYRPRAFIFSDCHSRVLEQLRGNVLLNGLSLEADITANLDSPRVTVAQLDWDVATVHQLSAFQPDVVIAAGNGQPQA

SEQ ID NO: 772212 - protein, 106 aa, Homo sapiens; identical to SEQ ID NO: 772206

SEQ ID NO: 772213 - protein, 106 aa, Homo sapiens; identical to SEQ ID NO: 772206

SEQ ID NO: 772214 - protein, 69 aa, Homo sapiens
RCTRVRICDHASRMAPEENAGTELLLQSFERRFLAARTLRSFPWQGGGGRAERPAGLAGVQGRRDGSPC

SEQ ID NO: 772215 - protein, 38 aa, Homo sapiens
MVLFEQDVVKGHWSCHSRATGCQGRRESCWPCVLGCGE

SEQ ID NO: 772216 - protein, 435 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772217 - protein, 376 aa, Homo sapiens
MIRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772218 - protein, 203 aa, Homo sapiens
MDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772219 - protein, 203 aa, Homo sapiens; identical to SEQ ID NO: 772218

SEQ ID NO: 772220 - protein, 435 aa, Homo sapiens; identical to SEQ ID NO: 772216

SEQ ID NO: 772221 - protein, 435 aa, Homo sapiens; identical to SEQ ID NO: 772216

SEQ ID NO: 772222 - protein, 253 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARREDGVSLCCPGW

SEQ ID NO: 772223 - protein, 435 aa, Homo sapiens; identical to SEQ ID NO: 772216

SEQ ID NO: 772224 - protein, 271 aa, Homo sapiens
GGNHLNLGGGGYSELEIAPLHSCLNNRVRLCLNKNSGDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772225 - protein, 278 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARSSCSYWRFCSQCCCPVGIRNTSNTSDSHGSSDGSPAS

SEQ ID NO: 772226 - protein, 179 aa, Homo sapiens
MVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772227 - protein, 195 aa, Homo sapiens
VILEDPKITQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772228 - protein, 377 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKE

SEQ ID NO: 772229 - protein, 254 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRCIFLNSFVPVRL

SEQ ID NO: 772230 - protein, 203 aa, Homo sapiens; identical to SEQ ID NO: 772218

SEQ ID NO: 772231 - protein, 376 aa, Homo sapiens; identical to SEQ ID NO: 772217

SEQ ID NO: 772232 - protein, 435 aa, Homo sapiens; identical to SEQ ID NO: 772216

SEQ ID NO: 772233 - protein, 405 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGSEDEAGCSSVDEESYKTLKQQEEVFRNLDAQYEMARSQTHTQRGMGLGFTSSMRGMDAV

SEQ ID NO: 772234 - protein, 203 aa, Homo sapiens; identical to SEQ ID NO: 772218

SEQ ID NO: 772235 - protein, 394 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 772236 - protein, 179 aa, Homo sapiens; identical to SEQ ID NO: 772226

SEQ ID NO: 772237 - protein, 376 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRLERAKKLQEQREKEMVEKQKQQEIAAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDRSSVDEESYKTLKQQEEVFRNLDAQYEMARSQTHTQRGMGLGFTSSMRGMDAV

SEQ ID NO: 772238 - protein, 110 aa, Homo sapiens [sequence omitted]

SEQ ID NO: 772239 - protein, 265 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARSGKAKNYKNSENGDNHSSCSRAAA

SEQ ID NO: 772240 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 772241 - protein, 118 aa, Homo sapiens
MESMGKITFVVMQTVKLRENTEESHNHVPTGMRTYKEELAPSQGGNTNASVTDEEEHGNILPKLNIEHGEKVNWLLGYKNKGTPNAGITGVSHHAQPNSLFLIVALYHILQMCESAMD

SEQ ID NO: 772242 - protein, 653 aa, Homo sapiens [sequence omitted]

SEQ ID NO: 772243 - protein, 650 aa, Homo sapiens
MISSKMMSSNPEEDPLDTFLQYIEDMGMKAYDGLVIQNASDIARENDRLRNETNLAYLKEKNEKRRRQEEAIKRIGGEVGRGHEGSYVGKHFRMGFMTMPAPQDRLPHPCSSGFSVRSQSLHSVGGTDDDSSCGSRRQPPPKPKRDPSTKLSTSSETVSSTAASKSGKTPERTEASAKPRPHSDEYSKKIPPPKPKRNPNTQLSTSFDETYIKKHGPRRTSLPRDSSLSQMGSPAGDPEEEEPVYIEMVGNILRDFRKEDDDQSEAVYEEMKYPIFDDLGQDAKCDFDHHSCSSQCATPTVPDLDFAKASVPCPPKGLLCDIPPPFPNLLSHRPPLLVFPPAPVHCSPNSDESPLTPLEVTKLPVLENVSYMKQPAGASPSTLPSHVPGHAKLEKEQAAALGPASATPALSSSPPPPSTLYRTQSPHGYPKSHSTSPSPVSMGRSLTPLSLKRPPPYDAVHSGSLSRSSPSVPHSTPRPVSQDGAKMVNAAVNTYGAAPGGSRSRTPTSPLEELTSLFSSGRSLLRKSSSGRRSKEPAEKSTEELKVRSHSTEPLPKLDNKERGHHGASSSREPVKAQEWDGTPGPPVVTSRLGRCSVSPTLLAGNHSSEPKVSCKLGRSASTSGVPPPSVTPLRQSSDLQQSQSFTLVA

SEQ ID NO: 772244 - protein, 248 aa, Homo sapiens
MWRWIRQQLGFDPPHQSDTRTIYVANRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGAR

SEQ ID NO: 772245 - protein, 163 aa, Homo sapiens
QQLGFDPTIIRVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGAR

SEQ ID NO: 772246 - protein, 80 aa, Homo sapiens
PDPQICGEGFPHTMKTSSQPARRRLPWNLSLSPASDVLGPHVIFNTGGKSTLVAKGLRLTLGILRLPGLGLLCEPEKVDP

SEQ ID NO: 772247 - protein, 244 aa, Homo sapiens
MSCPPSWPYCAPCPTNIGESTSPLRKTIETPTLWDPKAPSCSLELPPWVLASPQRSRGTALPFLPSNVLPSLALPSTSFLCRPLLSHLVTSLLAGPGAHDGHLRKEGWRSTPEMTSLPAPEHPASPCDSVLCSPDVSMCTLGPAARWDAQAKSAPLPPCCTDCKSFPHLQRPWAQPHTSQATSVDSGEAGTKGMSQFTVWTWWRSRPCETRQGEGIGNWGYSVTPGPPGSQNLPARLDGQGLAS

SEQ ID NO: 772248 - protein, 246 aa, Homo sapiens
MGTSVQAEVRARPAEGHFVLSSTAGHILWNVQTCTAHQTGSGVGLPSWAAPPGCLQNAEVTRAKAARQGARLLRNSEQVWSMAGRQLAPQHIARRAARSPGRSWQVPSWRMWGIGLGLVWLAFLDRSGQELKTVTPVSLQLFLMGFLFASQMHLHRTWILNCVTWRGRCERAMLLAQPVPVSVSVVSRPFCEPSVKLFVLQSASVDSVVGNSAAQTPSLPLPQTLQCHGAEGPVDPQLWPRKGCRS

SEQ ID NO: 772249 - protein, 54 aa, Homo sapiens
MESLWFTRLRHSLCLPPQPPKRLGLQCIPDFLDLFYEISPPDSLDRATPRFPCI

SEQ ID NO: 772250 - protein, 154 aa, Homo sapiens
SASEVRRSALGQRGVEGNQAWGSLEGLAGRHRPLWETDCGRGEPQPLSPHPSSLLSHLSPAAVAMRLPKGHCCHSLHSLEGSPQGTYSEQETCATQASWGCPQCSHDDNHSYHSPSPAHSLTYSIHNTPSSKASEVLPSSRLDSSVICLRPHSR

SEQ ID NO: 772251 - protein, 222 aa, Homo sapiens
LEIPQVFSPKHTYKAELSRNTRETRRLSRVGAEAAGEEDWKQRPPPLWGADWHNSYFSAIGEGAQSERWRREGRRSPTSLGAKSGFQIPQGKGLAGVGEGQGGSSGYPPPSALPNAVTVSPSHLSGQQQPWSQYLQVIQRADPPHPSFTPSLGFGRFSRGWVGRREPPRQTLPSLPPDSQTTGLGPQRFLTSALAQPGSRLQKAGATTIRGEGAALFLIPPS

SEQ ID NO: 772252 - protein, 200 aa, Homo sapiens
RTVDRTLVTRRDALLFQRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMVRDVG

SEQ ID NO: 772253 - protein, 242 aa, Homo sapiens
RTVDRTLVTRRDALLFQRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 772254 - protein, 242 aa, Homo sapiens; identical to SEQ ID NO: 772253

SEQ ID NO: 772255 - protein, 242 aa, Homo sapiens; identical to SEQ ID NO: 772253

SEQ ID NO: 772256 - protein, 242 aa, Homo sapiens; identical to SEQ ID NO: 772253

SEQ ID NO: 772257 - protein, 242 aa, Homo sapiens; identical to SEQ ID NO: 772253

SEQ ID NO: 772258 - protein, 242 aa, Homo sapiens; identical to SEQ ID NO: 772253

SEQ ID NO: 772259 - protein, 242 aa, Homo sapiens; identical to SEQ ID NO: 772253

SEQ ID NO: 772260 - protein, 200 aa, Homo sapiens; identical to SEQ ID NO: 772252

SEQ ID NO: 772261 - protein, 176 aa, Homo sapiens
RTVDRTLVTRRDALLFQRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELATSPASSSGAPAYAPCAPAGAGAAAGGRPHACHNPAGGAATARDH

SEQ ID NO: 772262 - protein, 186 aa, Homo sapiens
MVLGPRQPCVASWGCASALSLPKKAGMCWRAGMSEGPVSIAQKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLAA

SEQ ID NO: 772263 - protein, 32 aa, Homo sapiens
MSFSYVLLKLCNLDIDIVIRLLISIAINIIIN

SEQ ID NO: 772264 - protein, 472 aa, Homo sapiens
TREDRGQAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 772265 - protein, 139 aa, Homo sapiens [sequence omitted]

SEQ ID NO: 772266 - protein, 343 aa, Homo sapiens
TREDRGQAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDREPLCPPWYVFFKLALKSCPSESGAAV

SEQ ID NO: 772267 - protein, 270 aa, Homo sapiens
TREDRGQAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIHGYLGIGEWKLWGSDFLKRHL

SEQ ID NO: 772268 - protein, 472 aa, Homo sapiens; identical to SEQ ID NO: 772264

SEQ ID NO: 772269 - protein, 94 aa, Homo sapiens
ETGGGEGQRKSKYKILDATDQESLELKPTSRAGIKQKGLLLSSSLMHSESELDSDDAIFTWPDREKGKLLHGQNGSVPNGQTPLKARSPREEIL

SEQ ID NO: 772270 - protein, 99 aa, Homo sapiens
GPYYYYIRGPSILLLSLALETAGEEAQGDKIIDGAPCARGSHPWQVALLSGNQLHCGGVLVNERWVLTAAHCKMNEYTVHLGSDTLGQQEKMKVYSWNA

SEQ ID NO: 772271 - protein, 254 aa, Homo sapiens
GPYYYYIRGPSILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 772272 - protein, 128 aa, Homo sapiens
LWVSVSPPLSVSLSPLLSLGLCPHPVPQVFAHPLCHSVSSESVNVTPRSEYTVHLGSDTLGDRRAQRIKASKSFRHPGYSTQTHVNDLMLVKLNSQARLSSMVKKVRLPSRCEPPGTTCTVSGWGTTT

SEQ ID NO: 772273 - protein, 182 aa, Homo sapiens
FAEPGEAFPVVLSGGGDPISRAAPQPLSLPVLGASGAAAYGADMAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKARPRPRPRIKPRPRLQL

SEQ ID NO: 772274 - protein, 163 aa, Homo sapiens
SRVKNKNIYEKYPFSINVPQVWAGMAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKARPRPRPRIKPRPRLQL

SEQ ID NO: 772275 - protein, 181 aa, Homo sapiens
SPAGNLVRTPNAFPEIRWAPTITGRSQGAATRCQTKDVGILPQPQGGYRREFWRPPPQIQVAAPRQKSLFFKPGALQARKMADEAHIVASPKRGLKNFEENNGKNCGPPRAQMGEHHPFKMANAPLPGKPGGNKRPLPGKKETHVGPLEKPLGISRKIHATLGICKGNLLVWLRCLETLVN

SEQ ID NO: 772276 - protein, 105 aa, Homo sapiens
PSTHLGSMHAPEFPRTHLGSHAHTWVSMHTPGFPCTHLGSHAHTWVSMHTPGLPCTHLGSHAHTWAPMHTPGFPCTHLGSHAHTWAPMHTPGFPCTHLGSHAHTW

SEQ ID NO: 772277 - protein, 494 aa, Homo sapiens
MLTSKGQGFLHGGLCLWLCVFTPFFKGCVGCATEERLFHKLFSHYNQFIRPVENVSDPVTVHFEVAITQLANVDEVNQIMETNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 772278 - protein, 260 aa, Homo sapiens
PGWESRLCGWEDTSLCARVQPSRARKSGQLEKVVTVSRGILLPESPITERAKTTLPHTGRSPCRGGSPGRCWGRSEHRPFFTPDSLELGLGMPTWGTEATGCSEAGGFLLGSEGSRPQQSQERLGDTHCVLHLTQNCPRPAEEARARSLVAGQTFTLLFSIIFYAHIFVKCMAAIHQQLILQEVPPRRIGLSFANLASQVMRFIILLPDLPTTPVGTRSSTHLAELMTAWAQRSAHCANTRTGIAPLPEPPHRAPFKELA

SEQ ID NO: 772279 - protein, 70 aa, Homo sapiens
PDRLSNSPQVAELANGGGILPPYKVVVGHRREAPSIQHTIGAHEMMDIIRKKIRSLLNEQTVMMALPGCT

SEQ ID NO: 772280 - protein, 105 aa, Homo sapiens
SAWRVEVWLSVSGNSGKEGWVRSQRTFSILGSHNLSLLGCLCLPPCMVYPLEKRNLSPATLRVGPLSSLEEIWDSNCSAFTCSFLLVPLPLFVLAVPEPFEESMA

SEQ ID NO: 772281 - protein, 135 aa, Homo sapiens
PNHDTVCNLPKSPPLSATSPSLPHSVQPPQIPPLFATSQNLPMRNLAKSPPLCATSSNPPTVSNLPKSLPLCATSSSPPLCAPPKNPPTVCNLLKSPYCEQPPQISPLCATSPNPPLCATSPNPPTVSNLPKSPH

SEQ ID NO: 772282 - protein, 117 aa, Homo sapiens [sequence omitted]

SEQ ID NO: 772283 - protein, 1484 aa, Homo sapiens [sequence omitted]

SEQ ID NO: 772284 - protein, 176 aa, Homo sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKVSIFNILLT

SEQ ID NO: 772285 - protein, 68 aa, Homo sapiens
QPGAALHPGQFAKATFDAISKTYSYLTPDLWKETVFTKSPYQEFTDHLVKTHTRVSVQRTQAPAVATT

SEQ ID NO: 772286 - protein, 627 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772287 - protein, 786 aa, Homo sapiens
SPPLAARKRPGLPPGLATRAPLLPQYRAGAFRSCRFSPKEEGNQPTFSAPRLFSKSNVKTFASSDSLAKVQEVASWLLEMNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772288 - protein, 707 aa, Homo sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772289 - protein, 279 aa, Homo sapiens
MRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772290 - protein, 589 aa, Homo sapiens
MSKPGKPTLNHGLVPVDLKSAKEPLPHQTVMKIFSISIIAQGLPFCRRRMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772291 - protein, 627 aa, Homo sapiens; identical to SEQ ID NO: 772286

SEQ ID NO: 772292 - protein, 707 aa, Homo sapiens; identical to SEQ ID NO: 772288

SEQ ID NO: 772293 - protein, 249 aa, Homo sapiens
QVQPGCESARIHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 772294 - protein, 356 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKSAERTFAFRSSRPAWPNMVKHCLY

SEQ ID NO: 772295 - protein, 68 aa, Homo sapiens
QTLIKLKSLPTKNLAFLMSRLPSLPSLASPGCLPFSCVLSFLTSTITTITPPMNHEIGIIKTPQIQRG

SEQ ID NO: 772296 - protein, 248 aa, Homo sapiens
PEDALLRDQPRRLWQWWACLRVQEGPSPATADHDESVKTLSKGRALLYTLVSPAEGQLGTPSRPSKSEKSVTQDDSPNQYAGQDETSVSASDRRAHTKHDLSLQAQLQQKVFMEKWNHTSNDFILSGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMGYDRYLAIWPLSLLSYPHE

SEQ ID NO: 772297 - protein, 69 aa, Homo sapiens
GKPVRPGFPPLGQVQQGVLGVELLGDVVDTLDEGEGLASICTACSGGPTFMASRKTSRVGSVQKATVTA

SEQ ID NO: 772298 - protein, 137 aa, Homo sapiens
PRAHVLSRGSAQIHAWWAGGGKLGAGFFLPPSGALSPAGMELGACRFFSVPEPALSTGTCPALSSGFCPSSRGWYLSECQDSGRSVQQPFPRACASATLCPGFPGSRGSGPYPPCPQNRKHGALTVLLTKHLLSLCC

SEQ ID NO: 772299 - protein, 107 aa, Homo sapiens
PPILCLGTACLLAISLFYPYSPSSGVQTPAVLLPGTHHSSISGCPELLLLGQGWEVGKGSDGDVGSTSGFLTVPATLLGWINFVGPTKTLGSMLALAADMDVVSGNR

SEQ ID NO: 772300 - protein, 168 aa, Homo sapiens
PPILCLGTACLLAISLFYPYSPSSGVQTPAVLLPGTHHSSISGCPELLLLGQGWEVGKGSDGDVGSTSGFLTVPATLLGWINFVGPTKTLGSMLALAADMDVVSGKQTSSSKALLTPSPLSFSTLPPHFPQTSLGQGRGLMISEPAGGYLDSAWQSPAVRHLGLMLGG

SEQ ID NO: 772301 - protein, 162 aa, Homo sapiens
TARGRGTETGPRKPLSRKSNFIIEKSSVLNSLHHRHKFTYSICRRNGVGPICIMLLEGLTLLLNLNVAGARKQLLSCRRWQGESPQMDFDSKPHSPGLLITEGLDPRLKVDPRAGKNQCELLSPGYVCSQAEARYGGSLSILDDSLPCSAIYSTITGHWTQR

SEQ ID NO: 772302 - protein, 81 aa, Homo sapiens
GKGHTGIYSKGRDLTGIYSDERDLADIYSKGRGHTGSYSKGRGHTGIYSEGKNHPGINSDGGWATSVAVSGAVVGPISWGC

SEQ ID NO: 772303 - protein, 88 aa, Homo sapiens
MGKKQNRKTGNSKTQSASPPPKERSSSPATEQSWMENDFDELREEGFRRSNYSELREDIQTKGKEVENFEKNLEECITRITNTEKCLK

SEQ ID NO: 772304 - protein, 203 aa, Homo sapiens
TLATLPQSLAVLGACLCHGPGGNPCSCARMAASTRKLLLQLKQEEILQKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRWRTDILNGY

SEQ ID NO: 772305 - protein, 238 aa, Homo sapiens
MALPSFESTVIWRLLAMLDIKQQKMAQENMCCDKSGFAEASGLELAVLGACLCHGPGGNPCSCARMAASTRKLLLQLKQEEIFKSKEEAYVMADAFRIAFEQQLMRKNDQALQLTQMDKMHKKATKWMNWKHLKEDGFPSPRSKKTFGQRLLGMLPSENSSKRMEDQDSPQEVLKMLIDLLNDKEEALAHQRKVSYMLARALEDKDTASNENKEKNPIKENFPFNNPWRWRTDILNGY

SEQ ID NO: 772306 - protein, 238 aa, Homo sapiens; identical to SEQ ID NO: 772305

SEQ ID NO: 772307 - protein, 25 aa, Homo sapiens
MIMLMNFDIYRHDALHKGCTNLDHL

SEQ ID NO: 772308 - protein, 25 aa, Homo sapiens
MIMLMNFDIYRHDALHKGCTNLDHL

SEQ ID NO: 772309 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSERPGACNRCTEGVGYTNASNNLFACLPCTACKSDEEERSPCTTTRNTACQCKPGTFRNDNSAEMCRKCSTGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 772310 - protein, 104 aa, Homo sapiens [sequence omitted]

SEQ ID NO: 772311 - protein, 154 aa, Homo sapiens
MESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 772312 - protein, 274 aa, Homo sapiens
RGPRGQAGATRAWRQQSPLPQEAGPGDSTPLAAAWRVSLLPTPHDVSGSFGIDRAQVVPSSAATIKLHDQSIGTQQWEHSPLGELCPPGSHRSERPGACNRCTEGVGYTNASNNLFACLPCTACKSDEEERSPCTTTRNTACQCKPGTFRNDNSAEMCRKCSTGCPRGMVKVKDCTPWSDIECVHKESGNGHNIWVILVVTLVVPLLLVAVLIVCCCIGSGCGGDPKCMARVVFWRLVVSYEGLGLVDMLHRDLGQQTRGHFGSGAMGARAELA

SEQ ID NO: 772313 - protein, 468 aa, Homo sapiens; identical to SEQ ID NO: 772309

SEQ ID NO: 772314 - protein, 261 aa, Homo sapiens
QSGQLISQYKSLLQGGVPLGRQGTCWLTPRPPVPPLQRSTASCHRNRSQTALPTTSPRGTTWWTSACRPPRTDRSPTSCSAARTCDPCASTQRACTSSARPRHGILWPLPAVPLWPARSSPPSELCTAGPGPRKDRSQCYPVLPGEKLEAPVCCTHETRVPTASWRGGEGGRMDGAGQRRGGRADGAAFSPFPWPTLGSDCLPPSVTGWPSQPVVPTQNRALGQSPKNQAAGAGAGGPPGLSAPTRSSAHSSSHRPPTSAC

SEQ ID NO: 772315 - protein, 209 aa, Homo sapiens
RAALRGAGSAPVGCLWWGCGVADPAGSARTMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTGGRGPDGCG

SEQ ID NO: 772316 - protein, 144 aa, Homo sapiens
AGRSARRRLRPRRVFVVGLRSRRSRRKRQDNGDPGRRVRLPIQRYYRGAVGALLVYDIAKHLTYENVERWLKELRDHADSNIVIMLVGNKSDLRHLRAVPTDEARAFAEKNNLSFIETSALDSTNVEEAFKNILTGGRGPDGCG

SEQ ID NO: 772317 - protein, 248 aa, Homo sapiens
RAALRGAGSAPVGCLWWGCGVADPAGSARTMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 772318 - protein, 209 aa, Homo sapiens; identical to SEQ ID NO: 772315

SEQ ID NO: 772319 - protein, 94 aa, Homo sapiens
LPRAYYRWTRAHDLRGFLNFTLARAPSSFAAAHNRTCRYRAFRDDDGHYSQTYWNLLAIRLAFVIVFEVAEAPAGSPIHGMRPRPCALPNSSTW

SEQ ID NO: 772320 - protein, 50 aa, Homo sapiens [sequence omitted]

SEQ ID NO: 772321 - protein, 407 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 772322 - protein, 407 aa, Homo sapiens; identical to SEQ ID NO: 772321

SEQ ID NO: 772323 - protein, 407 aa, Homo sapiens; identical to SEQ ID NO: 772321

SEQ ID NO: 772324 - protein, 414 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTYFNFFSELQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 772325 - protein, 427 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 772326 - protein, 172 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRSYQRIGWGLS

SEQ ID NO: 772327 - protein, 339 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLEE

SEQ ID NO: 772328 - protein, 194 aa, Homo sapiens
GRVARARSVPCCGRWPLARLRRLSWRSKMAATAAAVVAEEDTELRDLLVQTLENSGVLNRIKVRPEAGAGPGGSAGLAWTAGVTTVAARRPPPWRGTGAGGHWGRAPAWPPSCPPHRGGRLVRSCGPGGHRGLGVPGPSPASFRGGGTAGLGGHTGGPQLGPGVRPQRLFLRLGHDPRRESSASSRSLGVGELV

SEQ ID NO: 772329 - protein, 330 aa, Homo sapiens
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKCPKMWTSILGIFFL

SEQ ID NO: 772330 - protein, 123 aa, Homo sapiens
MPRHLCAIPPTHHTTHASHHLYITPPVHHTDRKSHHPCITPPVHHAACAPHCSQITSHCLCTTLIANHTTPASQHPCITPPMHHTACAPHSLCTTSPVHHTTSSPALSSVLGPHCYGVLNMNL

SEQ ID NO: 772331 - protein, 120 aa, Homo sapiens
MSTTGQCGRRDALGLLRDDHERPYSFCLGLLDTHPGRSQTNLTTCYCQTGRKSVLATKRGLGACSMSPATRVLLGACFTSPATRVLTDETREIMKQQTHTTLSSVLTKKIVTCKKNKFLV

SEQ ID NO: 772332 - protein, 98 aa, Homo sapiens
TKNSNPYWDSGGLVAALCPQDLKKTALQTEAGKLDINLKELRTTTDSPGAAFVPGAAATQAAQERPPLQLLHATCSLQKVTTTGIPMPMPSSQTFTPH

SEQ ID NO: 772333 - protein, 52 aa, Homo sapiens
MRSTLSRVHCNCCVRFRFPATALLGERCHCVPAASGTESWDLRRQEGPALTG

SEQ ID NO: 772334 - protein, 613 aa, Homo sapiens
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFPGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKGDSVHFKGDSVHFKPDSVHFKPASSNPKPITGHHVSAGSHSKSAFSAATSHPKPIKPATSHAEPTTADYPKPATTSHPKPAAADNPELSASHCPEIPAIAHPVSDDSDLPESASSPAAGPTKPAASQLESDTIADLPDPTVVTTSTNDYHDVVVVDVEDDPDEMAV

SEQ ID NO: 772335 - protein, 79 aa, Homo sapiens
VFVFSRRLLLHSFSSAGDLGVCILEDCEEPQLLPSSSDQAVGSGSFGVSCGQQRLACSVGFFHITSDIFLLPNHRLMEY

SEQ ID NO: 772336 - protein, 63 aa, Homo sapiens
MTQAKPKPKMITPDSRPKNKNRVKSKQNEAVSPLAKPLVHTAQVLGKQQPLMHARNSFHGKPL

SEQ ID NO: 772337 - protein, 33 aa, Homo sapiens
HVEEVGSEESMATETMFMRGPGGIWRGWSLRLT

SEQ ID NO: 772338 - protein, 69 aa, Homo sapiens
NARVQKHLKALTSELANARDESKKTANDMIHAENMRLGRDKYKTLRQIRLGNTKQRIDECESMYWAPSL

SEQ ID NO: 772339 - protein, 2035 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772340 - protein, 905 aa, Homo sapiens
TYPLAFLPRYPEQHQGSPAWAAPQVLAYPLPQLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772341 - protein, 694 aa, Homo sapiens
MGNPRSFSSRPSRSPFAVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772342 - protein, 2054 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTETNWPMRSPSPKLWIPGPFTGEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772343 - protein, 2035 aa, Homo sapiens; identical to SEQ ID NO: 772339

SEQ ID NO: 772344 - protein, 2035 aa, Homo sapiens; identical to SEQ ID NO: 772339

SEQ ID NO: 772345 - protein, 75 aa, Homo sapiens
PRQHAWLIFVGTGFRHVGQAGFELLTSSDPPTSASQNVGITGFVGCLRDVVVGRHPLHLLEDAVTKPELRPCPTP

SEQ ID NO: 772346 - protein, 962 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGPARGYREELTVGWG

SEQ ID NO: 772347 - protein, 963 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQGEA

SEQ ID NO: 772348 - protein, 2035 aa, Homo sapiens; identical to SEQ ID NO: 772339

SEQ ID NO: 772349 - protein, 1940 aa, Homo sapiens
MPPLPLARDTRQPPGASLLVRGFMVPCNACLILLATATLGFAVLLFLNNYKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772350 - protein, 2186 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGEQGSRTWGGWAGAERLHQSLGSERVSPGLEPLEGSSVATPGPPVERASCYNSALGCCSDGKTPSLDAEGSNCPGEWTAGRGECEDSLGSAEVLPPRLGSRSVPGVMVLGLGPLKHVRAGDPTPNPSLSLQAGVAHCSEESSWYRHQPHPGVPTEPHDHLTNIHLPLHPCGLLLGPVPGPAWMPGRCQAGPHCTSPTATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772351 - protein, 1530 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772352 - protein, 224 aa, Homo sapiens
MARYEAGFISAAGRAAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 772353 - protein, 2035 aa, Homo sapiens; identical to SEQ ID NO: 772339

SEQ ID NO: 772354 - protein, 1164 aa, Homo sapiens
GPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGEQGSRTWGGWAGAERLHQSLGSERVSPGLEPLEGSSVATPGPPVERASCYNSALGCCSDGKTPSLDMTVSLCHTPGPARGYREELTVGWG

SEQ ID NO: 772355 - protein, 101 aa, Homo sapiens
SLLPFPIPSSSTAPLASPHRGWRGAVGDGRDQGPAEGAGPSLPVATPVPRTHSPPVPSSRRACFCAALHVTVSADTHWDCQGGVSRGPCLCPVLFQCGGQP

SEQ ID NO: 772356 - protein, 402 aa, Homo sapiens
MPPVSRSSYSEDIVGSRRRRRSSSGSPPSPQSRCSSWDGCSRSHSRGREGLRPPWSELDVGALYPFSRSGSRGRLPRFRNYAFASSWSTSYSGYRCHRHCYAEERQSAEDYEKEESHRQRRLKERERIGELGAPEVWGPSPKFPQLDSDEHTPVEDEEEVTHQKSSSSDSNSEEHRKKKTSRSRNKKKRKNKSSKRKHRKYSDSDSNSESDTNSDSDDDKKRVKAKKKKKKKKHKTKKKKNKKTKKESSDSSCKDSEEDLSEATWMEQPNVADTMDLIGPEAPIIHTSQDEKPLKYGHALLPGEGAAMAEYVKAGKRIPRRGEIGLTSEEIGSFECSGYVMSGSRHRRMEAVRLRKENQIYSADEKRALASFNQEERRKRESKILASFREMVHKKTKGKDDK

SEQ ID NO: 772357 - protein, 114 aa, Homo sapiens
CRSKDPCSLPAEEDSVLEKLGERKPCNSQPSELSSETSGIARPEEGRPVVSGTGNDITTPPNKELPPSPEKKTKAGKGGKKKQNKQDKQSPNKREARNSNIPNLIYRQVDTCFR

SEQ ID NO: 772358 - protein, 141 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTESL

SEQ ID NO: 772359 - protein, 211 aa, Homo sapiens
MADLSLADALTEPSPDIEGEIKRDFIATLEAEAFDDVVGETVGKTDYIPLLDVDEKTGNSESKKKPCSETSQIEDLPLPPHPASLSFHLPLDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYDRCCTQGGLGKLKFQTQS

SEQ ID NO: 772360 - protein, 313 aa, Homo sapiens
GSREATPGEMENSITPGCPVIGVVNDNSEQLKCESPLLVSLAHPAPIIEHSPTTIPPITMVFTQEHLNASCHIRDHDKELEKLSSTEEAVLNQAPQQKKAVRRALSECSHLSVPPAVNLADKYPELPAREEPSSGLLPPPSSPMPSPTPGKLGAPAMKRSMTVGEEQTASYKLSPGKLPILSTKEIPPFICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGMFLNFASIGNKQTARKEPK

SEQ ID NO: 772361 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 772362 - protein, 1152 aa, Homo sapiens; identical to SEQ ID NO: 772361

SEQ ID NO: 772363 - protein, 1152 aa, Homo sapiens; identical to SEQ ID NO: 772361

SEQ ID NO: 772364 - protein, 1152 aa, Homo sapiens; identical to SEQ ID NO: 772361

SEQ ID NO: 772365 - protein, 1114 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 772366 - protein, 1200 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETMQIETYRLTFRANARARTDHGADIVSRPPHFPGGPNSGSRVLGPLSRAVH

SEQ ID NO: 772367 - protein, 1152 aa, Homo sapiens; identical to SEQ ID NO: 772361

SEQ ID NO: 772368 - protein, 1094 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKCRLRPTG

SEQ ID NO: 772369 - protein, 1137 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 772370 - protein, 1152 aa, Homo sapiens; identical to SEQ ID NO: 772361

SEQ ID NO: 772371 - protein, 1185 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETMQIETYRLTFRANARARTDHGADIVSRPPHFPGGPNSGSRVLGPLSRAVH

SEQ ID NO: 772372 - protein, 1152 aa, Homo sapiens; identical to SEQ ID NO: 772361

SEQ ID NO: 772373 - protein, 1152 aa, Homo sapiens; identical to SEQ ID NO: 772361

SEQ ID NO: 772374 - protein, 1152 aa, Homo sapiens; identical to SEQ ID NO: 772361

SEQ ID NO: 772375 - protein, 1152 aa, Homo sapiens; identical to SEQ ID NO: 772361

SEQ ID NO: 772376 - protein, 1152 aa, Homo sapiens; identical to SEQ ID NO: 772361

SEQ ID NO: 772377 - protein, 1187 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETMQIETYRLTFRANARARTDHGADIVSRPRESGDRAEY

SEQ ID NO: 772378 - protein, 1094 aa, Homo sapiens; identical to SEQ ID NO: 772368

SEQ ID NO: 772379 - protein, 1079 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKGIPARPWDGCSEEKSRELY

SEQ ID NO: 772380 - protein, 1074 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKPCTLYKAPLHLVPLIERLGTPQQIAIAREGDLLTKERLCCGLSMFEVILTRIRSYLQDPIWLGPPPTNGVGTSMSVWSPPAVE

SEQ ID NO: 772381 - protein, 905 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVSHPPPPPNITKKTEHK

SEQ ID NO: 772382 - protein, 869 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSKLTVLE

SEQ ID NO: 772383 - protein, 640 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPGTCLCLFSVFLSTRL

SEQ ID NO: 772384 - protein, 978 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEATTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 772385 - protein, 117 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSLACLSTLGLLQHQTSDLS

SEQ ID NO: 772386 - protein, 134 aa, Homo sapiens
MADLSLADALTEPSPDIEGEIKRDFIATLEAEAFDDVVGETVGKTDYIPLLDVDEKTGNSESKKKPCSETSQIEDLPLPPHPASLSFHLPLDTPSSKPTLLANGGHGVEGSDTTGSLACLSTLGLLQHQTSDLS

SEQ ID NO: 772387 - protein, 72 aa, Homo sapiens
DLSPTPTSTKSTTVTPITTTTTVLGFPRMSPCNTAVVPQGWSVEALNSPHSESFVSPEAVAEPPQPTAEVNY

SEQ ID NO: 772388 - protein, 134 aa, Homo sapiens; identical to SEQ ID NO: 772386

SEQ ID NO: 772389 - protein, 1152 aa, Homo sapiens; identical to SEQ ID NO: 772361

SEQ ID NO: 772390 - protein, 1152 aa, Homo sapiens; identical to SEQ ID NO: 772361

SEQ ID NO: 772391 - protein, 1131 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETMQIETYRLTFRANARARTDHGADIVSRPPHFPGGPNSGSRVLGPLSRAVH

SEQ ID NO: 772392 - protein, 1121 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 772393 - protein, 1152 aa, Homo sapiens; identical to SEQ ID NO: 772361

SEQ ID NO: 772394 - protein, 1152 aa, Homo sapiens; identical to SEQ ID NO: 772361

SEQ ID NO: 772395 - protein, 1152 aa, Homo sapiens; identical to SEQ ID NO: 772361

SEQ ID NO: 772396 - protein, 1152 aa, Homo sapiens; identical to SEQ ID NO: 772361

SEQ ID NO: 772397 - protein, 1152 aa, Homo sapiens; identical to SEQ ID NO: 772361

SEQ ID NO: 772398 - protein, 1152 aa, Homo sapiens; identical to SEQ ID NO: 772361

SEQ ID NO: 772399 - protein, 1128 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKVASGSLGRHSWGGVGTMQLGSGSSQVGTCHRPSVSSGVMSS

SEQ ID NO: 772400 - protein, 1087 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGEWCLPCPLGLQGMSSCHGSAGQPAGWQGFHLCAFSIP

SEQ ID NO: 772401 - protein, 1017 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKAKVEKKTEAAATTRKPESNAVTKTAGPIASAQKQPAGKVQIVSKKVSYSHIQSKCGSKDNIKHVPGGGNCKYKLWLAGI

SEQ ID NO: 772402 - protein, 789 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKVSGHLTTVPRKIVPL

SEQ ID NO: 772403 - protein, 72 aa, Homo sapiens
CRSKDPCSLPAEEDSVLEKLGERKPCNSQPSELSSETSANFMYCGTPPTQAKQVCRPSDRRSTPAQACQGPS

SEQ ID NO: 772404 - protein, 249 aa, Homo sapiens
RDPVCSIQRKPFEEELAWDQPALEFPGPLKRHPAFLAPTAKARANWLLKYLLRTIVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 772405 - protein, 191 aa, Homo sapiens
MCFAKIMCTSTSFLLNTENHKDPKNVEATLKHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 772406 - protein, 98 aa, Homo sapiens
RLAAVPQSRGSPNAFHCVSVYIRVCKTRRRDRGPNRWGLAVLPRLGLNSWTQTILPPRPPKVLELQMEMGCHVVSCPMGKRLTCEELREASRKQPVKN

SEQ ID NO: 772407 - protein, 68 aa, Homo sapiens
PARRRAAVTRLSERLSLCFCLHSRLQDPAARPRPEQMEMGCHVVSCPMGKRLTCEELREASRKQPVKN

SEQ ID NO: 772408 - protein, 68 aa, Homo sapiens; identical to SEQ ID NO: 772407

SEQ ID NO: 772409 - protein, 244 aa, Homo sapiens
APVYDWSPQIQGIIFGAVGYGGILTMAPSGYLAGRVGTKRVVGISLFATSFLTLCIPLATDFGIVLLIVTRIVQGLSQSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDVSMFPSLPFSCLHG

SEQ ID NO: 772410 - protein, 249 aa, Homo sapiens
MATKTELSPTARESKNAQDMQVDETLIPRKVPSLCSARYGIALVLHFCNFTTIAQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDVSMFPSLPFSCLHG

SEQ ID NO: 772411 - protein, 420 aa, Homo sapiens
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 772412 - protein, 244 aa, Homo sapiens; identical to SEQ ID NO: 772409

SEQ ID NO: 772413 - protein, 267 aa, Homo sapiens
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDVSMFPSLPFSCLHG

SEQ ID NO: 772414 - protein, 163 aa, Homo sapiens
AGYQRRVPITAGGLPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772415 - protein, 157 aa, Homo sapiens
SAIMAGGVPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772416 - protein, 171 aa, Homo sapiens
ANWVTGPPSVSRVSISLKSNSVPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772417 - protein, 163 aa, Homo sapiens; identical to SEQ ID NO: 772414

SEQ ID NO: 772418 - protein, 172 aa, Homo sapiens
ADHVTAAPARRGRRLLAAVTSGFPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772419 - protein, 172 aa, Homo sapiens; identical to SEQ ID NO: 772418

SEQ ID NO: 772420 - protein, 172 aa, Homo sapiens; identical to SEQ ID NO: 772418

SEQ ID NO: 772421 - protein, 172 aa, Homo sapiens; identical to SEQ ID NO: 772418

SEQ ID NO: 772422 - protein, 172 aa, Homo sapiens; identical to SEQ ID NO: 772418

SEQ ID NO: 772423 - protein, 161 aa, Homo sapiens
LQSFRCFKTACRSQRHYIRKILQRYSTPSHSLYRMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772424 - protein, 127 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772425 - protein, 172 aa, Homo sapiens; identical to SEQ ID NO: 772418

SEQ ID NO: 772426 - protein, 172 aa, Homo sapiens; identical to SEQ ID NO: 772418

SEQ ID NO: 772427 - protein, 127 aa, Homo sapiens; identical to SEQ ID NO: 772424

SEQ ID NO: 772428 - protein, 84 aa, Homo sapiens
ARTLLLLLSSPVVMKALVMNKRIGKMRYVSVRDFKGKVLIDIREYWMDPEGEMKPGRKGISLNPEQWSQLKEQISDIDDAVRKL

SEQ ID NO: 772429 - protein, 122 aa, Homo sapiens
AGYQRRVPITAGGLPVLCQSRANDQEGVRLLEPSEAMPKSKELVSSSSSGSDSDSEVDKKIGKMRYVSVRDFKGKVLIDIREYWMDPEGEMKPGRKGISLNPEQWSQLKEQISDIDDAVRKL

SEQ ID NO: 772430 - protein, 129 aa, Homo sapiens
ADHVTAAPARRGRRLLAAVTSGFPVLCQSRANDQEGVRLLEPSEAMPKSKELVSSSSSGSDSDSEVDKKLKRKKQVAPEKPVKKQKTGETSRALSSSKQSSSSRDDNMFQELFITFITGVPPAQEVSGV

SEQ ID NO: 772431 - protein, 172 aa, Homo sapiens; identical to SEQ ID NO: 772418

SEQ ID NO: 772432 - protein, 172 aa, Homo sapiens; identical to SEQ ID NO: 772418

SEQ ID NO: 772433 - protein, 80 aa, Homo sapiens
DKHNYCCIIIIKCENKPFIGKMRYVSVRDFKGKVLIDIREYWMDPEGEMKPGRKGISLNPEQWSQLKEQISDIDDAVRKL

SEQ ID NO: 772434 - protein, 190 aa, Homo sapiens
MYETNNRGDTLGVLTPARGALLVFKIYKYDQQSRLESRERIPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 772435 - protein, 163 aa, Homo sapiens; identical to SEQ ID NO: 772414

SEQ ID NO: 772436 - protein, 172 aa, Homo sapiens; identical to SEQ ID NO: 772418

SEQ ID NO: 772437 - protein, 172 aa, Homo sapiens; identical to SEQ ID NO: 772418

SEQ ID NO: 772438 - protein, 127 aa, Homo sapiens; identical to SEQ ID NO: 772424

SEQ ID NO: 772439 - protein, 172 aa, Homo sapiens; identical to SEQ ID NO: 772418

SEQ ID NO: 772440 - protein, 172 aa, Homo sapiens; identical to SEQ ID NO: 772418

SEQ ID NO: 772441 - protein, 129 aa, Homo sapiens; identical to SEQ ID NO: 772430

SEQ ID NO: 772442 - protein, 188 aa, Homo sapiens
ADHVTAAPARRGRRLLAAVTSGFPVLCQSRANDQEGVRLLEPSEAMPKSKELVSSSSSGSDSDSEVDKKLKRKKQVAPEKPVKKQKTGETSRALSSSKQSSSSRDDNMFQIGKMRYVSVRDFKGKVLIDIREYWMDPDTAFPPVKPVSFHSPLQRRSLLHQLPAQSPLFSRSNPLLPKLSLQTSLTPL

SEQ ID NO: 772443 - protein, 94 aa, Homo sapiens
ADHVTAAPARRGRRLLAAVTSGFPVLCQSRANDQEGVRLLEPSEAMPKSKELVSSSSSGSDSDSEVDKKLKRKKQVAPEKPVKKQKTDWENEVR

SEQ ID NO: 772444 - protein, 336 aa, Homo sapiens
MSDKPGRRQTSIQNGQPHDGPRRLNDWRKFKLESQDSDSIPPSKKEILRQMSSPQSRNGKDSEAETGILTHSTRTPGTEIQTIISNPVPKMEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 772445 - protein, 194 aa, Homo sapiens
MSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 772446 - protein, 246 aa, Homo sapiens
MEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 772447 - protein, 199 aa, Homo sapiens
FQNQRQSAPGAMNGDDAFVRRPRVGSQIPQKMQKAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPPEDDE

SEQ ID NO: 772448 - protein, 240 aa, Homo sapiens
FQNQRQSAPGAMNGDDAFVRRPRVGSQIPQKMQKHPWRQVCDRGIHLVNLSPFWKVGREPASSIKALLCGRGEARAFDDIAKYFSEKEWEKMKASEKIIYVYMKRKYEAMTKLGFKATLPPFMRNKRVADFQGNDFDNDPNRGNQVEHPQMTFGRLQGIFPKITPEKPAEEGNDSKGVPEASGPQNNGKQLRPSGKLNTSEKVNKTSGPKRGKHAWTHRVRERKQLVIYEEISDPPEDDE

SEQ ID NO: 772449 - protein, 1790 aa, Homo sapiens
FLLEVATAAGLSGARTRLGSQVGGAMRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWRATNTDLLLAYANLMLLTLSTRDVQENRELLESFDSALQSAESSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPASPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLSVPLESVKQMLNSVMQELEDYSEGGPLYKNGSLRNADSEIKHSTPSPTRYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAGNVTPTKGSSNTDFKSTKEGFSIPVSADGFKFGISEPGNQEKKREKPLENDTGLQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVSQWKERGLGNLKILKNEVNGKLRMLMRREQVLKVCANHWITTTMNLKPLSGSDRAWMWSASHFSDGDAKLERLAAKFKTPELAEEFKQKFEECQRLLLDIPLQTPHKLVDTGRAAKLIQRAEEMKSGLKDFKTFLTNDQTKVTEEENKGSGTGAAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFVFGNSSATGSLFGFSFNAPLKSNNSETSSVAQSGSESKVEPKKCELSKNSDIEQPSDSKVKNLSASFPTEESSINYTFKTPEKEPPLWHAEFTKEELVQKLRSTTKSADHLNGLLREIEATNAVPMEQIKLLKSEIRRLERNQEREKSAANLEYLKNVLLQFIFLKPGSERERLLPVINTMLQLSPEEKGKLAAVAQDEEENASRSSG

SEQ ID NO: 772450 - protein, 70 aa, Homo sapiens
IMSNEMESVMSLLSKRSPGPDVVTAEFYHNFKEELIPILPKLFHKIEGERIPPNSFYKANIIMIPNYTGG

SEQ ID NO: 772451 - protein, 76 aa, Homo sapiens
EDEKQRPSKTYRKLRTWSVSKPNPPPPLMNYSLLAKKLFASCKNTPKGSKYLSVRHLRTKRLPKGPPPGALPGDPA

SEQ ID NO: 772452 - protein, 96 aa, Homo sapiens
VRGVESSFTISGSSSSHTAHSRIWSYCFMFQFLALTCHLFSREQGALQVSVFCVEPGLGAASPMPVCLLSTHSGSDTELEAGCAGEPGGECRCREW

SEQ ID NO: 772453 - protein, 81 aa, Homo sapiens
QVSPTQHVGCAWPAPGLGSGLGAVNTALRSSIMVCPSKKSLIWLRGLGHSSQAGPTLAGGPGAAEEMGLSEETICSLQVKL

SEQ ID NO: 772454 - protein, 1536 aa, Homo sapiens
GWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQAKVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 772455 - protein, 257 aa, Homo sapiens
MRGNRLREVQQLGGGCPGGGSTGLGGQFGPETGLGTGIVSSSKTVRTEAMRPRALRPWHPAPRPMSSLELFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 772456 - protein, 398 aa, Homo sapiens
LEGRLRAANSLALRRVAAAFSLAPLAERCGRVLRQAFAEVARHADFLELAPDEVVALLADPALGVAREEAVFEAAMRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVGVGLRRERALKAGVPTVCQAQNWAFPCPCPFIHLIPSNSPDQSPPCFREGNEQKNDPKVTQWVSSTLGLKCLGWCHVSFIHFKN

SEQ ID NO: 772457 - protein, 246 aa, Homo sapiens
LEGRLRAANSLALRRVAAAFSLAPLAERCGRVLRQAFAEVARHADFLELAPDEVVALLADPALGVAREEAVFEAAMRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGEGGAATGAHTGLTSSLRTPPPLLFPPIGREGRDVF

SEQ ID NO: 772458 - protein, 438 aa, Homo sapiens
LEGRLRAANSLALRRVAAAFSLAPLAERCGRVLRQAFAEVARHADFLELAPDEVVALLADPALGVAREEAVFEAAMRWVRHDAPARRGQLRRLLEHVRLPLLAPAYFLEKVEADELLQACGECRPLLLEARACFILGREAGALRTRPRRFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 772459 - protein, 230 aa, Homo sapiens
MFSSHLHTWIKVASLHKGRWRHKMAVVQGQVGTSCSGCPGTKLFAVGGFDGLRRLHSVERYDPFSNTWAAAAPLPEAVSSAAVASCAGKLFVIGGARQGGVNTDKVQCFDPKEDRWSLRSPAPFSQRCLEAVSLEDTIYVMGGLMSKIFTYDPGTDVWGEAAVLPSPVESCGVTVCDGKVHILGGRDDRGESTDKVFTFDPSSGQVEVQPSLQRCTSSHGCVTIIQSLGR

SEQ ID NO: 772460 - protein, 134 aa, Homo sapiens
LVLISWDYRCEPPHPAIISCFRKQELKIHLHIYYLLYHVDLSFAAISMGFGIVTNFFHHFQPHPNLFFLLFISTPKACIHLPLIRYLLMILHCLKNEISFNLTPAFSFVAILYSVCPQLNFTICHSQLPSPNPA

SEQ ID NO: 772461 - protein, 110 aa, Homo sapiens
LFSGKCILSHIPKRKVTYLYVIIWRFNRKNLKGHAHKNPILEKPGIGHAVAKGLSWFGGVPFLRKSVLNISIKIIGETSPTLPGGYPESSRNKGVRKRQSKSLKGASRAL

SEQ ID NO: 772462 - protein, 45 aa, Homo sapiens
TGGDLPKAFGVQPSHSCAMDVGQGFQKDDFGAVGLNDWPTAFWTF

SEQ ID NO: 772463 - protein, 445 aa, Homo sapiens
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 772464 - protein, 445 aa, Homo sapiens; identical to SEQ ID NO: 772463

SEQ ID NO: 772465 - protein, 445 aa, Homo sapiens; identical to SEQ ID NO: 772463

SEQ ID NO: 772466 - protein, 119 aa, Homo sapiens [sequence omitted]

SEQ ID NO: 772467 - protein, 69 aa, Homo sapiens
ARGNAGPLCATLSPSPREEASPPCPEQHSESEMKLLSHLPQPSSPASQVRVPRQPATASASERVDQASG

SEQ ID NO: 772468 - protein, 96 aa, Homo sapiens
MIHICLCQEPGEGLAQAGPGCSWESRLAWRKAEDLHGSFWKADPLLISEATFSATVAFRCLPSSSALPTHISYTSLLPEATVETTTLPATVSDRFS

SEQ ID NO: 772469 - protein, 502 aa, Homo sapiens
SCGHLPQAMDLSNNTMSLSVRTPGLSRRLSSQSVIGRPRGMSASSVGSGYGGSAFGFGASCGGGFSAASMFGSSSGFGGGSGSSMAGGLGAGYGRALGGGSFGGLGMGFGGSPGGGSLGILSGNDGGLLSGSEKETMQNLNDRLASYLDKVRALEEANTELENKIREWYETRGTGTADASQSDYSKYYPLIEDLRNKIISASIGNAQLLLQIDNARLAAEDFRMKYENELALRQGVEADINGLRRVLDELTLTRTDLEMQIESLNEELAYMKKNHEDELQSFRVGGPGEVSVEMDAAPGVDLTRLLNDMRAQYETIAEQNRKDAEAWFIEKSGELRKEISTNTEQLQSSKSEVTDLRRAFQNLEIELQSQLAMKKSLEDSLAEAEGDYCAQLSQVQQLISNLEAQLLQVRADAERQNVDHQRLLNVKARLELEIETYRRLLDGEAQGDGLEESLFVTDSKSQAQSTDSSKDPTKTRKIKTVVQEMVNGEVVSSQVQEIEELM

SEQ ID NO: 772470 - protein, 38 aa, Homo sapiens
MGKEQSVRGGSPQSYNSKQFSAQASLLPLFQFTSFATS

SEQ ID NO: 772471 - protein, 59 aa, Homo sapiens
GGVRFPGESPRGTEGGRTTLRAQEALEGQLGTSDSESGSAVRGWGKEVSSQESWCQGLR

SEQ ID NO: 772472 - protein, 73 aa, Homo sapiens
MTLGHNMIYLQTAETSRTPFDLAEGESELVSGFNIEYAAGPFALFFIAEYTNIIIINTLTTTIFLGTTYDAFS

SEQ ID NO: 772473 - protein, 73 aa, Homo sapiens
MTLGHNMIYLQTTETSRTPFDLAEGESELVSGFNIEYAAGPFALFFIAEYTNIIIINTLTTTIFLGTTYDAFS

SEQ ID NO: 772474 - protein, 126 aa, Homo sapiens
MECIKQTLVCKTQGQLKLYINVHYMSGFYFTYKAPLTLHPYHNTRTPLITPAIMTLGHNMIYLQTTETSRTPFDLAEGESELVSGFNIEYAAGPFALFFIAEYTNIIIINTLTTTIFLGTTYDAFS

SEQ ID NO: 772475 - protein, 109 aa, Homo sapiens
MYFANSPTPVIIPLTSILLVEARRTVMFIDSICLLGDMFLESVLVKNQVRKEVKGSSSYFSQRNTTVTYKVSGSRSKVCVVPYYILEDCFTVLLLYSVYVFANSLSFCQ

SEQ ID NO: 772476 - protein, 321 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772477 - protein, 319 aa, Homo sapiens
MGSELSGAGRGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLASLSESGEYMKWAQYPHRARTMRPIQGGSRGEMKAGSSRGSTMDHHGERENKKQKQALRPRPRHGTRTERKDRMAARTSRDR

SEQ ID NO: 772478 - protein, 356 aa, Homo sapiens
SRPRPPPGSAGSRSAPGRKPLSGSRRWGWTQGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772479 - protein, 356 aa, Homo sapiens; identical to SEQ ID NO: 772478

SEQ ID NO: 772480 - protein, 321 aa, Homo sapiens; identical to SEQ ID NO: 772476

SEQ ID NO: 772481 - protein, 339 aa, Homo sapiens
TRPPTRPAGGGAGRGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772482 - protein, 321 aa, Homo sapiens; identical to SEQ ID NO: 772476

SEQ ID NO: 772483 - protein, 243 aa, Homo sapiens
ALSVGLARDRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772484 - protein, 341 aa, Homo sapiens
SRPRPPPGSAGSRSAPGRKPLSGSRRWGWTQGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQGEP

SEQ ID NO: 772485 - protein, 431 aa, Homo sapiens
SRPRPPPGSAGSRSAPGRKPLSGSRRWGWTQGATDMGEPQGSMRILVTGGSGLVGKAIQKVVADGAGLPGEDWVFVSSKDADLTWLAWPGCAWLCSWKNKHPPISSWKPAPSYQPGPGATLPFDCPSCHSPTQFLHLAPNLGCWFPPEPPDSLASYRDTAQTRALFEKVQPTHVIHLAAMVGGLFRNIKYNLDFWRKNVHMNDNVLHSAFEVGARKVVSCLSTCIFPDKTTYPIDETMIHHGLPQNSQYWGNSYAQRMTRQLQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772486 - protein, 147 aa, Homo sapiens
MGEPQGSMRILVTGGSGLVGKAIQKVVADGAGLPGEDWVFVSSKDADLTDTAQTRALFEKVQPTHVIHLVGEEDEVSIKEAAEAVVEAMDFHGEVTFDTTKSDGQFKKTASNSKLRTYLPDFRFTPFKQAVKETCAWFTDNYEQARK

SEQ ID NO: 772487 - protein, 335 aa, Homo sapiens
PGGEFGTRGRGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772488 - protein, 335 aa, Homo sapiens
MGSELSGAGRGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 772489 - protein, 356 aa, Homo sapiens; identical to SEQ ID NO: 772478

SEQ ID NO: 772490 - protein, 196 aa, Homo sapiens
SRPRPPPGSAGSRSAPGRKPLSGSRRWGWTQGATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRSSRPSC

SEQ ID NO: 772491 - protein, 192 aa, Homo sapiens [sequence omitted]

SEQ ID NO: 772492 - protein, 170 aa, Homo sapiens [sequence omitted]

SEQ ID NO: 772493 - protein, 356 aa, Homo sapiens; identical to SEQ ID NO: 772478

SEQ ID NO: 772494 - protein, 139 aa, Homo sapiens
QSVGITGMSHHAWPFFLFFFFPFQEKRSKVPSTVCLFVCFETEFFSVTQAGVQWCDLGPTATSTSRFKQFSCPSLPTSGVAGIIGACQYARLIFVFLVEMRFHYVGQAGFECLTSGDLPASASKSVGITGVSYPARPLL

SEQ ID NO: 772495 - protein, 78 aa, Homo sapiens
MTWGSVSISWEAQESAFDSFLIEVSNSDHPHETMVLSVPGVSRSSVITNLKASSNYTAHLHGLIGGQRAQTLMVQATT

SEQ ID NO: 772496 - protein, 45 aa, Homo sapiens
MELLLSSLQRSFECSWEDDTYPRHNIRIQQSNFNHSFIQNIWAYW

SEQ ID NO: 772497 - protein, 234 aa, Homo sapiens
HLLALQIIRDLVDKGGDIFLDQLARLGVISKVSTLAGPSSDDENEEESKPEKEDEPQEDAKELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKL

SEQ ID NO: 772498 - protein, 94 aa, Homo sapiens
MPSSLLAVDNRVLSRSGSFPELQPPTYHSHSAQTPQPCSWSCQAYVCLRGLTLAGTLDPGAFTRLTHSLLRCFCSEGHLLTSLSPRLVPPPPLY

SEQ ID NO: 772499 - protein, 103 aa, Homo sapiens
MPWVPQDPWGQAQLLPPQLHQTPPASGRGSASLAHWPPMGPSSSGGGTQPMRQRKEGWAAVSAGWEPWPPPGPTLVCWVWCIFPSKCTDVSYRHLGGYWVVAW

SEQ ID NO: 772500 - protein, 187 aa, Homo sapiens
SIARRFGPRSRTGGRTPGPRPALADLPRVEGGRRRRSSPPRRTPKWSFRTRGVWPGVSGLTAPRAERLFAEEGPPGREPERGGARPVPARRCPARGTAAPPGPSPARPQLAPGPRGQAGRERGDVHGGPARALLLPPGPPCAGGGGPSLRAAEARPAAPTASPPPCGPAASGASWDPGPRRAGRRQR

SEQ ID NO: 772501 - protein, 579 aa, Homo sapiens
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGATLTAAVFVATDSWYFSSPATSRNLVLTPVNFLHYNLNPQNLARHGTHARLTHLAVNGFLLFGVLHAQALQAAWQQLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 772502 - protein, 111 aa, Homo sapiens
AAAGQDSRPDMERPRSPQCSAPASASASVTLAQLLQLVQQGQELPGLEKRHIAAIHGEPTASRLPRRPKPWEAAALAESLPPPTLRIGTAPAEPGLVEAATAPSSWHTVGP

SEQ ID NO: 772503 - protein, 111 aa, Homo sapiens; identical to SEQ ID NO: 772502

SEQ ID NO: 772504 - protein, 107 aa, Homo sapiens
MPAIFINALPPPNTIGGPALIISLQVYPAAPERQRPARRGHDDGGGFVKTKMGICREKKERSDCYCVYIEREDIRDSILKKTCTLNNCFAEMLLICSFAPATLPQPL

SEQ ID NO: 772505 - protein, 106 aa, Homo sapiens
LLCLELYRILGHLVAQGLICHPWSLSSPRADEALAYLVYFLWESGPCKLARSLLCRGAVSGYVGVPGATSVFILNSCIAWHSIRRRPLLQGQLCLTTPSSFLKFFF

SEQ ID NO: 772506 - protein, 98 aa, Homo sapiens
VLVLRKDVKESNQQSSLSRDKRANRGPEQVFLWPVAKGLTQPSTYKCAAEPSHWEGSSEGHSHSSDKKLCSQRGSCQTEALLLRHTLHGSEIPAENTL
